United States Patent
Hahn et al.

(10) Patent No.: US 12,391,993 B2
(45) Date of Patent: *Aug. 19, 2025

(54) METHODS, TREATMENT, AND COMPOSITIONS FOR CHARACTERIZING THYROID NODULE

(71) Applicant: City of Hope, Duarte, CA (US)

(72) Inventors: Maria A. Hahn, Duarte, CA (US); John H. Yim, San Marino, CA (US); Yuman Fong, Duarte, CA (US); Arthur X. Li, Covina, CA (US); Xiwei Wu, Diamond Bar, CA (US)

(73) Assignee: CITY OF HOPE, Duarte, CA (US)

( * ) Notice: Subject to any disclaimer, the term of this patent is extended or adjusted under 35 U.S.C. 154(b) by 37 days.

This patent is subject to a terminal disclaimer.

(21) Appl. No.: 17/813,904

(22) Filed: Jul. 20, 2022

(65) Prior Publication Data
US 2023/0227913 A1    Jul. 20, 2023

Related U.S. Application Data

(63) Continuation of application No. 15/217,645, filed on Jul. 22, 2016, now Pat. No. 11,505,829.

(60) Provisional application No. 62/196,678, filed on Jul. 24, 2015.

(51) Int. Cl.
*C12Q 1/6886* (2018.01)
(52) U.S. Cl.
CPC ...... *C12Q 1/6886* (2013.01); *C12Q 2600/118* (2013.01); *C12Q 2600/154* (2013.01)
(58) Field of Classification Search
CPC ............ C12Q 1/6886; C12Q 2600/118; C12Q 2600/154
See application file for complete search history.

(56) References Cited

U.S. PATENT DOCUMENTS

2017/0022570 A1    1/2017   Hahn et al.

OTHER PUBLICATIONS

Cottrell, S.E. (Jul. 2004). "Molecular diagnostic applications of DNA methylation technology," *Clin Biochem* 37(7):595-604.
Dean, D.S. et al. (2008) "Epidemiology of thyroid nodules," *Best Pract Res Clin Endocrinol Metab* 22(6):901-911.
Ellis, R.J. et al. (Feb. 2014, e-published Dec. 11, 2013). "Genome-wide methylation patterns in papillary thyroid cancer are distinct based on histological subtype and tumor genotype," *J Clin Endocrinol Metab* 99(2):E329-E337.
Gu, H. et al. (Feb. 2010, e-published Jan. 10, 2010). "Genome-scale DNA methylation mapping of clinical samples at single-nucleotide resolution," *Nature Methods* 7(2)133-136.
Hansen, K.D. et al. (Jun. 26, 2011). "Increased methylation variation in epigenetic domains across cancer types," *Nature Genetics* 43(8):768-775.
Ionnidis, J.P.A. (Aug. 2005). "Why most published research findings are false," *PLoS Med* 2(8):e124.
UCSC Genome Browser on Human Feb. 2009 (GRCh37/hg19) Assembly, 3 pages.
Kent, W.J. et al. (2002) "The human genome browser at UCSC," *Genome Res* 12(6):996-1006.
Kroese, M. et al. (Nov.-Dec. 2004). "Genetic tests and their evaluation: can we answer the key questions?" *Genetics in Medicine* 6(6):475-480.

*Primary Examiner* — Sarae L Bausch
(74) *Attorney, Agent, or Firm* — Mintz, Levin, Cohn, Ferris, Glovsky and Popeo, P.C.

(57) ABSTRACT

The current disclosure provides, inter alia, method of determining benign nodules from thyroid cancer in a subject that is found to have a thyroid nodule, method of treating thyroid cancer in a subject detected to have thyroid cancer by the method of the current disclosure, compositions for determining benign nodules from thyroid cancer in a subject, and kits including reagents and composition for determining benign nodules from thyroid cancer in a subject.

20 Claims, 7 Drawing Sheets

Specification includes a Sequence Listing.

METHODS, TREATMENT, AND COMPOSITIONS FOR CHARACTERIZING THYROID NODULE

CROSS-REFERENCE TO RELATED APPLICATIONS

This application is a continuation of U.S. patent application Ser. No. 15/217,645, filed Jul. 22, 2016, now U.S. Pat. No. 11,505,829, issued on Nov. 22, 2022, which claims the benefit of priority under 35 U.S.C. § 119 (e) to U.S. Provisional Application No. 62/196,678, filed Jul. 24, 2015, the content of which are incorporated herein by reference in their entireties.

INCORPORATION-BY-REFERENCE OF SEQUENCE LISTING

The content of the XML file named "048440-573C01US_Sequence_Listing.xml", which was created on Dec. 2, 2022, and is 22,950 kilobytes in size, is hereby incorporated by reference in its entirety.

BACKGROUND OF THE DISCLOSURE

Palpable thyroid nodules are typically detected in 2-6% of the population, and this increases to 19-35% with ultrasound detection (Dean D S and Gharib H. Best Pract Res Clin Endocrinol Metab 2008; 22:901-11). Approximately 5-15% of thyroid nodules are found to be thyroid cancer, making the existence of a nodule clinically relevant. Fine needle aspiration (FNA) with cytology is currently the standard diagnostic procedure used to evaluate thyroid nodules. However, in as many as 30% of cases, the cytological diagnosis is indeterminate because of cytological features that overlap between benign and malignant nodules. For most indeterminate cases half or the entire thyroid is resected, yet as many as 80% of these cases are found to be benign.

Most thyroid nodules do not cause symptoms. Often, thyroid nodules are discovered incidentally during a routine physical examination or on imaging tests like CT scans or neck ultrasound done for completely unrelated reasons. Occasionally, patients themselves find thyroid nodules by noticing a lump in their neck while looking in a mirror, buttoning their collar, or fastening a necklace. Abnormal thyroid function tests may occasionally be the reason a thyroid nodule is found. Thyroid nodules may produce excess amounts of thyroid hormone causing hyperthyroidism. However, most thyroid nodules, including those that cancerous, are actually non-functioning, meaning current diagnostic test readouts such as the level of Thyroid-Stimulating Hormone (TSH) are normal. Rarely, patients with thyroid nodules may complain of pain in the neck, jaw, or ear. If a nodule is large enough to compress the windpipe or esophagus, it may cause difficulty with breathing, swallowing, or cause a "tickle in the throat". Even less commonly, hoarseness can be caused if the nodule invades the nerve that controls the vocal cords but this is usually related to thyroid cancer.

Molecular testing is a potential alternative to cytopathological examination. However, FNA molecular testing based on DNA mutations frequently fails. There are two major reasons for this failure: (i) not all papillary thyroid carcinoma (PTC) specimens are characterized by a common set of cancer associated mutations, and (ii) cancer associated mutations like KRAS are frequently found in benign thyroid nodule (BTN) specimens. At the same time commercial diagnostic tests for FNA based on transcriptional activity and currently implemented in clinical practice is complicated due to RNA instability and associated with only an approximately 50% positive predictive value. Thus, there is an urgent need for highly sensitive, low cost biomarker panels that can accurately diagnose thyroid nodules from FNA biopsies.

BRIEF SUMMARY OF THE DISCLOSURE

The present subject matter provides, inter alia, a method of determining benign nodules from thyroid cancer in a subject that is found to have a thyroid nodule, a method of treating thyroid cancer in a subject detected to have thyroid cancer, compositions for determining benign nodules from thyroid cancer in a subject, and kits including reagents and compositions for determining benign nodules from thyroid cancer in a subject.

In embodiments, aspects of the present subject matter provide a method of detecting methylation or unmethylation of a thyroid nodule DNA of a subject, the method including: (i) isolating DNA from a thyroid nodule of the subject thereby forming isolated thyroid nodule DNA, (ii) contacting the isolated thyroid nodule DNA with a bisulfite salt (such as sodium bisulfite) thereby forming a reacted thyroid nodule DNA, (iii) detecting the presence or absence of uracil in the reacted thyroid nodule DNA at a methylation site set forth in Table 1, thereby detecting methylation or unmethylation of the thyroid nodule DNA of the subject.

Also provided is a method of determining a thyroid cancer or risk of developing thyroid cancer in a subject in need thereof. The method includes isolating DNA from a thyroid nodule of the subject thereby forming isolated thyroid nodule DNA. The isolated thyroid nodule DNA is contacted with sodium bisulfite thereby forming a reacted thyroid nodule DNA. The presence or absence of uracil is detected in the reacted thyroid nodule DNA at a methylation site set forth in Table 1 thereby determining thyroid cancer in the subject.

In embodiments, provided herein is a method of treating thyroid cancer in a subject by administering to the subject an active agent for treating thyroid cancer. The method includes identifying the subject for treatment by a method including isolating DNA from a thyroid nodule of the subject thereby forming isolated thyroid nodule DNA. The isolated thyroid nodule DNA is contacted with sodium bisulfite thereby forming a reacted thyroid nodule DNA. The presence or absence of uracil in the reacted thyroid nodule DNA is detected at a methylation site set forth in Table 1 thereby determining thyroid cancer in the subject.

Also included herein is a deoxyribonucleic acid 5 to 100, 5 to 200, 5 to 300, or at least about 5, 50, 100, 150, 200, 250, 300, or more nucleotides in length including a uracil-containing sequence identical to at least a 5 contiguous nucleotides within a sequence including SEQ ID NO: 1 to SEQ ID NO:550.

In embodiments, provided herein is an oligonucleotide 5 to 100, 5 to 200, 5 to 300, or at least about 5, 50, 100, 150, 200, 250, 300, or more nucleotides in length including identical or complementary to at least 5, 10, 20, 25, 50, 100, 150, 200, 250, or 300 contiguous nucleotides within a sequence including SEQ ID NO:1 to SEQ ID NO:550.

Aspects of the present subject matter also include a deoxyribonucleic acid including SEQ ID NO: 551 to SEQ ID NO: 782, in which the nucleic acid is hybridized to a complementary DNA sequence having uridine or cytosine.

Also provided is a kit including a plurality (e.g., at least about 10, 20, 40, 50, 100, 150, 200, 225, or 232) nucleic acids each independently comprising SEQ ID NO: 551 to SEQ ID NO: 782, in which the nucleic acids do not simultaneously include the same sequence of SEQ ID NO: 551 to SEQ ID NO: 782.

Aspects of the present subject matter also provide a system for detecting methylation or unmethylation of a thyroid nodule deoxyribonucleic acid (DNA) of a subject. The system can include at least one processor; and at least one memory including program code which when executed by the at least one memory provides operations. The operations can include: isolating DNA from a thyroid nodule of the subject thereby forming isolated thyroid nodule DNA; contacting the isolated thyroid nodule DNA with bisulfite salt thereby forming a reacted thyroid nodule DNA; detecting a presence or absence of uracil in the reacted thyroid nodule DNA at a plurality of methylation sites set forth in Table 1, thereby detecting methylation or unmethylation of the thyroid nodule DNA of the subject; and generating a diagnosis for the subject based at least in part on the presence or absence of uracil in the reacted thyroid nodule DNA at the plurality of methylation sites set forth in Table 1; and providing, via a user interface, the diagnosis for the subject.

BRIEF DESCRIPTION OF THE DRAWINGS

FIG. 1A: Adenoma specific hypomethylation signature. FIG. 1B: Adenoma specific hypermethylation signature.

FIG. 2B: 364 CpG sites associated with benign- and thyroid cancer-specific DNA methylation changes. Each row represents a single cytosine. Each column represents tissue specimen. Dark gray, light gray and black indicate high, low and medium levels of DNA methylation, respectively. Abbreviation "A" is for thyroid benign nodule and "T" is for thyroid cancer.

FIG. 3A: Thyroid cancer diagnostics based on benign DNA methylation signature, cancer DNA methylation signature and cancer risk scores. FIG. 3B: DNA methylation signatures for malignant and benign thyroid nodules according to leave one-out-cross-validation technique. Specimens with indeterminate epigenetic signature are underlined. Abbreviation "A" is for thyroid benign nodule and "T" is for thyroid cancer. FIG. 3C: Algorithm for the diagnosis prediction based on BTN, PTC and cancer risk scores.

DETAILED DESCRIPTION OF THE DISCLOSURE

Figure 1B:
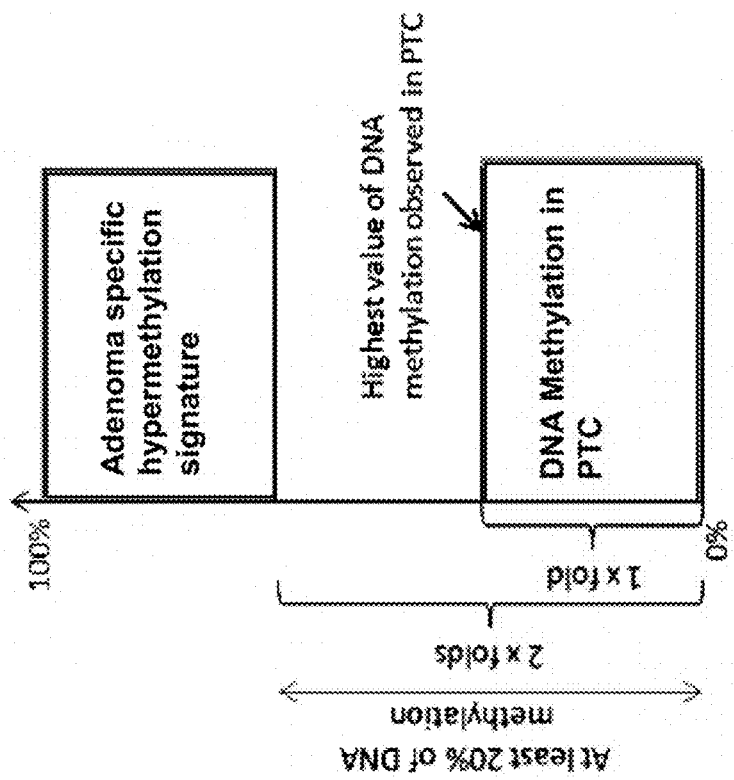
FIGS. 1A-1B show a drawing defining a threshold for thyroid adenoma specific signature for individual cytosine regions.

Provided herein are, inter alia, compositions, methods, kits, and systems for detecting unmethylated DNA. In embodiments, compositions, methods, kits, and systems for detecting unmethylated DNA from thyroid nodule are included herein.

The following definitions are included for the purpose of understanding the present subject matter and for constructing the appended patent claims. Abbreviations used herein have their conventional meaning within the chemical and biological arts.

Definitions

The term "thyroid nodule" is used according to its plain ordinary meaning and refers to an abnormal growth of thyroid cells. The abnormal growth may form, for example, a mass or lump within or on the thyroid gland. The mass or lump may be fluid-filled or solid. The thyroid nodules may be benign (noncancerous) or cancerous.

Thyroid fine needle aspiration biopsy (FNA or FNAB): For a fine needle biopsy, a needle is used to withdraw cells from a thyroid nodule. In embodiments, several samples are taken from different parts of the nodule, e.g., to increase the chance of finding cancerous cells if they are present. In embodiments, a sample is taken from one part of the nodule. In embodiments, examination of the cells under a microscope is not necessary. In non-limiting examples, the needle used for FNA is a 20-35 gauge needle (such as a 23, 24 or 25 gauge needle).

The term "disease" refers to any deviation from the normal health of a mammal and includes a state when disease symptoms are present, as well as conditions in which a deviation (e.g., infection, gene mutation, genetic defect, etc.) has occurred, but symptoms are not yet manifested. According to the present disclosure, the methods disclosed herein are suitable for use in a patient that is a member of the Vertebrate class, Mammalia, including, without limitation, primates, livestock and domestic pets (e.g., a companion animal). Typically, a patient will be a human patient. As used herein, a "symptom" of a disease includes and clinical or laboratory manifestation associated with the disease, and is not limited to what a subject can feel or observe.

The terms "subject," "patient," "individual," and the like as used herein are not intended to be limiting and can be generally interchanged. That is, an individual described as a "patient" does not necessarily have a given disease, but may be merely seeking medical advice.

The term "subject" as used herein includes all members of the animal kingdom that may suffer from the indicated disorder. In some aspects, the subject is a mammal, and in some aspects, the subject is a human.

It must be noted that as used herein and in the appended embodiments, the singular forms "a," "an," and "the" include the plural reference unless the context clearly dictates otherwise. Thus, for example, a reference to "a disease," "a disease state", "a nucleic acid" or "a CpG site" is a reference to one or more such embodiments, and includes equivalents thereof known to those skilled in the art and so forth.

Throughout the description and claims of this specification the word "comprise" and other forms of the word, such as "comprising" and "comprises," means including but not limited to, and is not intended to exclude, for example, other components.

A "control" sample or value refers to a sample that serves as a reference, usually a known reference, for comparison to a test sample. For example, a test sample can be taken from a patient suspected or at risk of having thyroid cancer and compared to samples from a known thyroid cancer patient, or a known normal (non-disease) individual. A control can also represent an average value gathered from a population of similar individuals, e.g., thyroid cancer patients or healthy individuals with a similar medical background, same age, weight, etc. A control value can also be obtained from the same individual, e.g., from an earlier-obtained sample, prior to disease, or prior to treatment. One of skill will recognize that controls can be designed for assessment of any number of parameters.

One of skill in the art will understand which controls are valuable in a given situation and be able to analyze data based on comparisons to control values. Controls are also valuable for determining the significance of data. For example, if values for a given parameter are widely variant in controls, variation in test samples will not be considered as significant.

The term "diagnosis" refers to a relative probability that a disease is present in the subject. Similarly, the term "prognosis" refers to a relative probability that a certain future outcome may occur in the subject. For example, in the context of the present disclosure, prognosis can refer to the likelihood that an individual will develop a disease, or the likely severity of the disease (e.g., severity of symptoms, rate of functional decline, survival, etc.). The terms are not intended to be absolute, as will be appreciated by any one of skill in the field of medical diagnostics.

"Nucleic acid" or "oligonucleotide" or "polynucleotide" or grammatical equivalents used herein means at least two nucleotides covalently linked together. Oligonucleotides are typically from about 5, 6, 7, 8, 9, 10, 12, 15, 25, 30, 40, 50 or more nucleotides in length, up to about 100 nucleotides in length. Nucleic acids, including ribonucleic acids (RNA) and deoxyribonucleic acids (DNA), and polynucleotides are a polymers of any length, including longer lengths, e.g., 200, 300, 500, 1000, 2000, 3000, 5000, 7000, 10,000, etc. A nucleic acid of the present invention will generally contain phosphodiester bonds, although in some cases, nucleic acid analogs are included that may have alternate backbones, comprising, e.g., phosphoramidate, phosphorothioate, phosphorodithioate, or O-methylphophoroamidite linkages (see Eckstein, Oligonucleotides and Analogues: A Practical Approach, Oxford University Press); and peptide nucleic acid backbones and linkages. Other analog nucleic acids include those with positive backbones; non-ionic backbones, and non-ribose backbones, including those described in U.S. Pat. Nos. 5,235,033 and 5,034,506, and Chapters 6 and 7, ASC Symposium Series 580, *Carbohydrate Modifications in Antisense Research*, Sanghui & Cook, eds. Nucleic acids containing one or more carbocyclic sugars are also included within one definition of nucleic acids. Modifications of the ribose-phosphate backbone may be done for a variety of reasons, e.g., to increase the stability and half-life of such molecules in physiological environments or as probes on a biochip. Mixtures of naturally occurring nucleic acids and analogs can be made; alternatively, mixtures of different nucleic acid analogs, and mixtures of naturally occurring nucleic acids and analogs may be made.

The term "bp" and the like refer, in the usual and customary sense, to the indicated number of base pairs.

The terms "identical" or percent "identity," in the context of two or more nucleic acids (e.g., genomic sequences or subsequences or coding sequences) or polypeptide sequences, refer to two or more sequences or subsequences that are the same or have a specified percentage of amino acid residues or nucleotides that are the same (i.e., 50%, 55%, 60%, 65%, 70%, 75%, 80%, 85%, 90%, 91%, 92%, 93%, 94%, 95%, 96%, 97%, 98%, 99%, or more identity over a specified region), when compared and aligned for maximum correspondence over a comparison window, or designated region as measured using one of the following sequence comparison algorithms or by manual alignment and visual inspection. Such sequences are then said to be "substantially identical." This definition also refers to the compliment of a test sequence. Optionally, the identity exists over a region that is at least about 10 to about 100, about 20 to about 75, about 30 to about 50 amino acids or nucleotides in length.

An example of algorithms suitable for determining percent sequence identity and sequence similarity are the BLAST and BLAST 2.0 algorithms, which are described in Altschul et al., *Nuc. Acids Res.* 25:3389-3402 (1977) and Altschul et al., *J. Mol. Biol.* 215:403-410 (1990), respectively. As will be appreciated by one of skill in the art, the software for performing BLAST analyses is publicly available through the website of the National Center for Biotechnology Information.

A "label" or a "detectable moiety" is a composition detectable by spectroscopic, photochemical, biochemical, immunochemical, chemical, or other physical means. For example, useful labels include $^{32}$P, fluorescent dyes, electron-dense reagents, enzymes (e.g., as commonly used in an ELISA), biotin, digoxigenin, or haptens and proteins or other entities which can be made detectable, e.g., by incorporating a radiolabel into a peptide or antibody specifically reactive with a target peptide. Any method known in the art for conjugating an antibody to the label may be employed, e.g., using methods described in Hermanson, Bioconjugate Techniques 1996, Academic Press, Inc., San Diego.

The term "associated" or "associated with" in the context of a substance (e.g., level of uracil or methylation level in a thyroid nodule) does not necessarily mean that the disease is caused by (in whole or in part), or a symptom of the disease is caused by (in whole or in part) the substance or substance activity or function (i.e., level of uracil in the regions of chromosomes assayed).

The term "unmethylated DNA" or "demethylated DNA" means DNA that lacks a methyl group conjugated to cytosine in a segment of the DNA. DNA methylation typically occurs in a CpG dinucleotide context. DNA methylation at 5' position of cytosine may have the specific effect on gene expression in vivo. DNA methylation may also form the basis of epigenetic structure, which typically enables a single cell to grow into multiple organs or perform multiple functions.

The CpG sites or CG sites are regions of DNA where a cytosine nucleotide occurs next to a guanine nucleotide in the linear sequence of bases along its length. "CpG" is shorthand for "-C-phosphate-G-", that is, cytosine and guanine separated by only one phosphate; phosphate links any two nucleosides together in DNA. The "CpG" notation is used to distinguish this linear sequence from the CG base-pairing of cytosine and guanine. The CpG notation can also be interpreted as the cytosine being 5' prime to the guanine base.

In embodiments, methylation is detected based on a chemical reaction of sodium bisulfite with DNA that converts unmethylated cytosines of CpG dinucleotides to uracil or UpG. However, methylated cytosine is not converted in this process, the methods described herein allow determination of methylation status as methylated or unmethylated.

Evaluation of Thyroid Fine Needle Biopsies by Visual Examination

Cells in a thyroid vine needle biopsy sample may be examined under a microscope by, e.g., a pathologist. The report of a thyroid fine needle biopsy followed by examination under a microscope will usually indicate one of the following findings:

1. The nodule is benign (noncancerous). This result is obtained in up to 80% of biopsies. The risk of overlooking a cancer when the biopsy is benign is generally less than 3 in 100 tests or 3%. This is even lower when the biopsy is reviewed by an experienced pathologist at a major medical center. Generally, benign thyroid nodules do not need to be removed unless they are causing symptoms like choking or difficulty swallowing. Follow up ultrasound exams are important. Occasionally, another biopsy may be required in the future, especially if the nodule grows over time.

2. The nodule is malignant (cancerous) or suspicious for malignancy. A malignant result is obtained in about 5% of biopsies and is most often due to papillary cancer, which is the most common type of thyroid cancer. A malignant diagnosis has a >99% risk of cancer in the nodule. A suspicious biopsy has a 50-75% risk of cancer in the nodule. These diagnoses require surgical removal of the thyroid after consultation with the endocrinologist and surgeon.

3. The nodule is indeterminate. This is actually a group of several diagnoses that may occur in up to 30% of cases. An indeterminate finding means that even though an adequate number of cells was removed during the fine needle biopsy, examination with a microscope cannot reliably classify the result as benign or cancer. The biopsy may be indeterminate because the nodule is described as a Follicular Lesion. These nodules are cancerous 20-30% of the time. However, under the current state of the art, the diagnosis can only be made by surgery. Because the odds that the nodule is not a cancer are much better by surgery (70-80%), only the side of the thyroid with the nodule is usually removed. If a cancer is found, the remaining thyroid gland is usually removed as well. If the surgery confirms that no cancer is present, no additional surgery to "complete" the thyroidectomy is necessary.

The biopsy may also be indeterminate because the cells from the nodule have features that cannot be placed in one of the other diagnostic categories. This diagnosis is called atypia, or a follicular lesion of undetermined significance. Diagnoses in this category will contain cancer rarely, so repeat evaluation with FNA or surgical biopsy to remove half of the thyroid containing the nodule is usually recommended.

4. The biopsy may also be non-diagnostic or inadequate. This result indicates that not enough cells were obtained to make a diagnosis but is a common result if the nodule is a cyst. These nodules may require reevaluation with second fine needle biopsy, or may need to be removed surgically depending on the clinical judgment of the doctor.

Methods, compositions, kits, and systems provided herein provide significant advantages over the visual examination of biopsies.

Method of Detection Methylation Status of a Thyroid Nodule DNA

In an aspect, provided herein is a method of detecting methylation or unmethylation of a thyroid nodule DNA of a subject. The method includes: (i) isolating a thyroid nodule DNA molecule from a thyroid nodule of the subject thereby forming an isolated thyroid nodule DNA molecule, (ii) contacting the isolated thyroid nodule DNA molecule with a bisulfite salt (such as sodium bisulfite) thereby forming a reacted thyroid nodule DNA molecule, (iii) detecting the presence or absence of uracil in the reacted thyroid nodule DNA molecule at a methylation site set forth in Table 1, thereby detecting methylation or unmethylation of the thyroid nodule DNA molecule of the subject. In embodiments, contacting the isolated thyroid nodule DNA with a bisulfite salt comprises adding a solution comprising the bisulfite salt to a solution comprising the isolated single stranded DNA.

In an aspect, provided herein is a method of detecting methylation or unmethylation of a thyroid nodule DNA molecule of a subject comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) detecting the level of reacted thyroid nodule DNA molecules in the plurality of reacted thyroid nodule DNA molecules having a uracil at a methylation site set forth in Table 1, thereby detecting the level of methylation or unmethylation in the plurality of thyroid nodule DNA molecules of the subject.

In an aspect, provided herein is a method of detecting methylation or unmethylation of a thyroid nodule DNA molecule of a subject comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) detecting the presence or absence of uracil in a reacted thyroid nodule DNA molecule at a methylation site set forth in Table 1, thereby detecting methylation or unmethylation of the thyroid nodule DNA molecule of the subject.

In an aspect, provided herein is a method of detecting methylation or unmethylation of a thyroid nodule DNA of a subject. The method includes: (i) isolating a thyroid nodule DNA molecule from a thyroid nodule of the subject thereby forming an isolated thyroid nodule DNA molecule, (ii) contacting the isolated thyroid nodule DNA molecule with a bisulfite salt (such as sodium bisulfite) thereby forming a reacted thyroid nodule DNA molecule, (iii) amplifying the reacted thyroid nodule DNA molecule thereby forming a reacted thyroid nodule DNA amplicon molecule, (iv) detecting the presence or absence of thymidine in a reacted thyroid nodule DNA amplicon molecule at a methylation site set forth in Table 1, thereby detecting methylation or unmethylation of the thyroid nodule DNA molecule of the subject. In embodiments, contacting the isolated thyroid nodule DNA with a bisulfite salt comprises adding a solution comprising the bisulfite salt to a solution comprising the isolated single stranded DNA.

In an aspect, provided herein is a method of detecting methylation or unmethylation of a thyroid nodule DNA molecule of a subject comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) amplifying the plurality of reacted thyroid nodule DNA molecules thereby forming a plurality of reacted thyroid nodule DNA amplicon molecules, (iv) detecting one or more thyroid nodule DNA amplicon molecules within the plurality of reacted thyroid nodule DNA amplicon molecules having a thymidine at a methylation site set forth in Table 1, thereby detecting methylation or unmethylation of the thyroid nodule DNA molecule of the subject.

In embodiments, detecting one or more thyroid nodule DNA amplicon molecules comprises detecting the level of one or more one or more thyroid nodule DNA amplicon molecules. In embodiments, detecting one or more thyroid nodule DNA amplicon molecules comprises detecting the level of reacted thyroid nodule DNA amplicon molecules in the plurality of reacted thyroid nodule DNA amplicon molecules having a thymidine at a methylation site set forth in Table 1, thereby detecting the level of methylation or unmethylation in the plurality of thyroid nodule DNA molecules of the subject.

In embodiments, detecting a level includes determining the number (e.g. quantitating) or molecules having, e.g., a thymidine or a uracil. In embodiments, detecting a level includes detecting the portion or proportion of a population or plurality of molecules having, e.g., a thymidine or a uracil.

In embodiments, the isolated thyroid nodule DNA sample is treated with a bisulfite reagent, e.g., a bisulfite salt (i.e., a process called DNA bisulfite conversion). Non-limiting examples of bisulfite salts include sodium bisulfite, potassium bisulfite, ammonium bisulfite, magnesium bisulfite, sodium metabisulfite, potassium metabisulfite, ammonium metabisulfite and magnesium metabisulfite. Bisulfite salts such as sodium bisulfite or ammonium bisulfite can convert cytosine to uracil and leave 5-methylcytosine (5-mC) the same. Thus after bisulfite treatment methylated cytosine in the DNA remains the same and unmodified cytosines will be changed to uracil. The bisulfite treatment can be performed by using the methods disclosed herein or in the art, and/or with commercial kits such as the Bisulflash DNA Modification Kit (Epigentek) and Imprint DNA Modification Kit (Sigma). For achieving the optimal bisulfite conversion, the bisulfite reaction should be carried out in an appropriate concentration of bisulfite reagents, appropriate temperature and appropriate reaction time period. A reagent such as potassium chloride that reduces thermophilic DNA degradation could also be used in bisulfite treatment so that the DNA bisulfite process can be much shorter without interrupting a completed conversion of unmethylated cytosine to uracil and without a significant thermodegradation of DNA resulted from depurination. In embodiments, a commercially available bisulfite treatment kit is used. A non-limiting example of such a kit is EZ DNA Methylation-Gold™ Kit (Zymo Research, Irvine, CA, USA).

In embodiments, once DNA bisulfite conversion is complete, DNA is captured, desulphonated and washed. In embodiments, the bisulfite-treated DNA can be captured by, e.g., a solid matrix selected from silica salt, silica dioxide, silica polymers, magnetic beads, glass fiber, celite diatoms and nitrocellulose in the presence of high concentrations of chaotropic or non-chaotropic salts. In embodiments, the bisulfite-treated DNA is further desulphonated with an alkalized solution, preferably sodium hydroxide at concentrations from 10 mM to 300 mM. In embodiments, the DNA is then eluted and collected into a capped microcentrifuge tube. Non-limiting examples of elution solutions include DEPC-treated water and TE buffer (10 mM Tris-HCL, pH 8.0, and 1 mM EDTA).

In embodiments, the reacted thyroid nodule DNA resulting from bisulfite treatment is amplified. In embodiments, detecting the presence or absence of uracil in reacted thyroid nodule DNA molecule at a methylation site comprises amplifying the reacted thyroid nodule DNA molecule thereby forming a reacted thyroid nodule DNA amplicon molecule, and detecting the presence or absence of thymidine in a reacted thyroid nodule DNA amplicon molecule at the methylation site. In embodiments, a polymerase chain reaction (PCR) method is used for amplifying the reacted thyroid nodule DNA. PCR methods are known to those of ordinary skill in the art. In general, the PCR reactions can be set up by adding sample, dNTPs, and appropriate polymerase such as Taq polymerase, primers, and a buffer.

In embodiments, the method of detecting methylation or unmethylation of a thyroid nodule DNA of a subject, includes detecting methylation or unmethylation at a plurality of methylation sites set forth in Table 1. In embodiments, the plurality of methylation sites comprises at least about 2, 3, 4, 5, 10, 25, 50, 75, 80, 85, 90, 100, 150, 200, 250, 300, 350, 400, 450, 500, or 550, or 5-550 methylation sites. In embodiments, the plurality of methylation sites comprises less than about 550, 500, 450, 400, 350, 300, 250, 200, 150, 100, 90, 85, 80, 75, 50, 25, or 10 methylation sites. In embodiments, the plurality of methylation sites is about 5, 6, 7, 8, 9, 10, 11, 12, 13, 14, 15, 16, 17, 18, 19, 20, 25, 50, 75, 80, 85, 90, 100, 150, 200, 250, 300, 350, 400, 450, 500, or 550, or 5-550 methylation sites. In embodiments, the plurality of methylation sites includes two or more methylation sites set forth in Table 1 and no other methylation sites.

In embodiments, the method includes detecting methylation or unmethylation of at least 1, 2, 3, 4, 5, 6, 7, 8, 9, 10, 50, 100, 200, 300, 400, or 500 of the following sites: Chromosome 1 (Chr1) position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chromosome 2 (Chr2) position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chromosome 3 (Chr3) position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chromosome 4 (Chr4) position 3743223, Chr4 position 5755716, Chr4 position 5755717, Chr4 position 5755728, Chr4 position 5755729, Chr4 position 5755734, Chr4 position 8372861, Chr4 position 57548289, Chromosome 5 (Chr5) position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chromosome 6 (Chr6) position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chromosome 7 (Chr7) position 989235, Chr7 position 2673543, Chr7 position 73508602, Chr7 position 105079565, Chr7 position 105079631, Chr7 position 151425103, Chr7 position 151425104, Chromosome 8 (Chr8) position 11764017, Chr8 position 21647308, Chr8 position 22548399, Chr8 position 22548483, Chr8 position 133570537, Chr8 position 141320393, Chr8 position 141320410, Chromosome 9 (Chr9) position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chromosome 10 (Chr10) position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chromosome 11 (Chr11) position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chromosome 12 (Chr12) position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chromosome 13 (Chr13) position 20735797, Chr13 position 23500419, Chr13 position 46771519, Chr13 position 46771520, Chr13 position 53313426, Chr13 position 113807393, Chromosome 14 (Chr14) position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chromosome 15 (Chr15) position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chromosome 16 (Chr16) position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chromosome 17 (Chr17) position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chromosome 18 (Chr18) position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chromosome 19 (Chr19) position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chromosome 20 (Chr20) position 34206950, Chr20 position 36771969, Chr20 position 48993661, Chr20 position 58406398, Chr20 position 61976049, Chr20 position 61976073, Chr20 position 62588571, Chr20 position 62588579, Chromosome 22 (Chr22) position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 1 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 2 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 3 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 4 of the following sites:

Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94486789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 5 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 6 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 7 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 8 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 9 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 10 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 50 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 100 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676671, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 200 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 300 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 400 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, the method includes detecting methylation or unmethylation of at least 500 of the following sites: Chr1 position 2996653, Chr1 position 11979164, Chr1 position 12655938, Chr1 position 16450525, Chr1 position 16450542, Chr1 position 16450545, Chr1 position 16469987, Chr1 position 17494491, Chr1 position 25473203, Chr1 position 27640460, Chr1 position 29565080, Chr1 position 38493013, Chr1 position 38493030, Chr1 position 38493074, Chr1 position 46713777, Chr1 position 46914121, Chr1 position 46955744, Chr1 position 55008344, Chr1 position 109816092, Chr1 position 109816111, Chr1 position 110074669, Chr1 position 110074681, Chr1 position 110074685, Chr1 position 150949856, Chr1 position 150949857, Chr1 position 153540282, Chr1 position 155162704, Chr1 position 155162714, Chr1 position 156676611, Chr1 position 157611881, Chr1 position 182205324, Chr1 position 204118999, Chr1 position 206741875, Chr1 position 206741989, Chr1 position 212587673, Chr1 position 212841198, Chr1 position 223403952, Chr1 position 233430972, Chr1 position 234342767, Chr2 position 3454277, Chr2 position 8793724, Chr2 position 20412441, Chr2 position 42329402, Chr2 position 42329494, Chr2 position 55289272, Chr2 position 65064865, Chr2 position 70823641, Chr2 position 73143689, Chr2 position 74454110, Chr2 position 122014529, Chr2 position 128158884, Chr2 position 128158910, Chr2 position 203114171, Chr2 position 218221671, Chr2 position 219745335, Chr2 position 238341465, Chr2 position 238341542, Chr2 position 238341546, Chr2 position 238774763, Chr3 position 13323642, Chr3 position 14180153, Chr3 position 45209073, Chr3 position 45209207, Chr3 position 52525100, Chr3 position 62589658, Chr3 position 65388317, Chr3 position 65388388, Chr3 position 73599302, Chr3 position 195636893, Chr3 position 197093846, Chr4 position 3743223, Chr4 position 5755716, Chr4 position 5755717, Chr4 position 5755728, Chr4 position 5755729, Chr4 position 5755734, Chr4 position 8372861, Chr4 position 57548289, Chr5 position 1118280, Chr5 position 34564389, Chr5 position 73871907, Chr5 position 78013596, Chr5 position 78013643, Chr5 position 137802650, Chr5 position 139051189, Chr5 position 167838221, Chr5 position 177541401, Chr5 position 180018672, Chr5 position 180101026, Chr6 position 3394325, Chr6 position 3887581, Chr6 position 7236568, Chr6 position 7728692, Chr6 position 34203617, Chr6 position 37751320, Chr6 position 41410682, Chr6 position 41438516, Chr6 position 41438575, Chr6 position 43464150, Chr6 position 158734279, Chr7 position 989235, Chr7 position 2673543, Chr7 position 73508602, Chr7 position 105079565, Chr7 position 105079631, Chr7 position 151425103, Chr7 position 151425104, Chr8 position 11764017, Chr8 position 21647308, Chr8 position 22548399, Chr8 position 22548483, Chr8 position 133570537, Chr8 position 141320393, Chr8 position 141320410, Chr9 position 6566568, Chr9 position 16197862, Chr9 position 34591313, Chr9 position 98225096, Chr9 position 126126741, Chr9 position 132083428, Chr9 position 136077410, Chr9 position 139655018, Chr9 position 140205985, Chr9 position 140205985, Chr9 position 140205997, Chr10 position 3929071, Chr10 position 30047012, Chr10 position 79702989, Chr10 position 87984905, Chr10 position 94838789, Chr10 position 102131187, Chr10 position 104196489, Chr10 position 111766879, Chr10 position 112258886, Chr10 position 112258984, Chr10 position 112259015, Chr10 position 116391763, Chr10 position 120011530, Chr10 position 126172714, Chr10 position 126172747, Chr11 position 556355, Chr11 position 821282, Chr11 position 12188937, Chr11 position 12188948, Chr11 position 12188995, Chr11 position 36057726, Chr11 position 48070143, Chr11 position 48070163, Chr11 position 48070166, Chr11 position 48070174, Chr11 position 65158294, Chr11 position 65158342, Chr11 position 65297089, Chr11 position 66104481, Chr11 position 66104485, Chr11 position 66104578, Chr11 position 68608767, Chr11 position 70236292, Chr11 position 70236320, Chr11 position 70236331, Chr11 position 115530032, Chr11 position 117950310, Chr11 position 117950329, Chr11 position 117950361, Chr11 position 117950362, Chr11 position 119293593, Chr12 position 679803, Chr12 position 26039132, Chr12 position 31004558, Chr12 position 45610695, Chr12 position 45610701, Chr12 position 45610702, Chr12 position 45610706, Chr12 position 50286016, Chr12 position 52243258, Chr12 position 52243286, Chr12 position 54145732, Chr12 position 54145741, Chr12 position 54145825, Chr12 position 56115043, Chr12 position 66262229, Chr12 position 66262230, Chr12 position 66262233, Chr12 position 66262234, Chr12 position 77266621, Chr12 position 117580102, Chr12 position 123435962, Chr12 position 123436011, Chr12 position 123436065, Chr12 position 123540893, Chr13 position 20735797, Chr13 position 23500419, Chr13 position 46771519, Chr13 position 46771520, Chr13 position 53313426, Chr13 position 113807393, Chr14 position 38599118, Chr14 position 69170010, Chr14 position 75701632, Chr14 position 75701643, Chr14 position 90850454, Chr14 position 97524282, Chr14 position 103541602, Chr14 position 103768055, Chr14 position 104209000, Chr14 position 104209068, Chr14 position 104354645, Chr14 position 104360487, Chr15 position 41068807, Chr15 position 61152225, Chr15 position 61152253, Chr15 position 61152313, Chr15 position 65186440, Chr15 position 68851629, Chr15 position 70667596, Chr15 position 70767206, Chr15 position 75251486, Chr15 position 77984014, Chr15 position 77989064, Chr15 position 83952081, Chr15 position 85402496, Chr15 position 85402497, Chr15 position 99417337, Chr16 position 1231873, Chr16 position 1458639, Chr16 position 3023231, Chr16 position 23135832, Chr16 position 29616265, Chr16 position 31009547, Chr16 position 31009548, Chr16 position 31009590, Chr16 position 57793674, Chr16 position 57793715, Chr16 position 57793727, Chr16 position 70771056, Chr16 position 70771079, Chr16 position 70771141, Chr16 position 77332010, Chr16 position 78540378, Chr16 position 79333435, Chr16 position 84262419, Chr16 position 88701114, Chr16 position 89988308, Chr16 position 89988644, Chr17 position 1509928, Chr17 position 1509945, Chr17 position 1509952, Chr17 position 1509953, Chr17 position 7644013, Chr17 position 16323460, Chr17 position 16323473, Chr17 position 16924561, Chr17 position 16924562, Chr17 position 16924594, Chr17 position 17717918, Chr17 position 17718591, Chr17 position 18139506, Chr17 position 35278031, Chr17 position 39677570, Chr17 position 40826257, Chr17 position 43037426, Chr17 position 43200096, Chr17 position 43200239, Chr17 position 43510142, Chr17 position 47987828, Chr17 position 48178379, Chr17 position 48596391, Chr17 position 48764165, Chr17 position 55701962, Chr17 position 73584599, Chr17 position 73993165, Chr17 position 75827716, Chr17 position 76882243, Chr17 position 78765910, Chr17 position 79544478, Chr17 position 80696474, Chr18 position 19751759, Chr18 position 21440760, Chr18 position 45555437, Chr18 position 45555438, Chr18 position 46547891, Chr18 position 55888885, Chr18 position 56452096, Chr18 position 56452476, Chr18 position 56887181, Chr18 position 76002973, Chr18 position 77331090, Chr19 position 677895, Chr19 position 884044, Chr19 position 884059, Chr19 position 884105, Chr19 position 884115, Chr19 position 1136511, Chr19 position 1177605, Chr19 position 1177612, Chr19 position 1177640, Chr19 position 1860601, Chr19 position 1860607, Chr19 position 2503954, Chr19 position 3434917, Chr19 position 3434921, Chr19 position 3434930, Chr19 position 3434939, Chr19 position 3434952, Chr19 position 3434954, Chr19 position 3434962, Chr19 position 3434964, Chr19 position 3434979, Chr19 position 3434985, Chr19 position 4052713, Chr19 position 4052714, Chr19 position 4052749, Chr19 position 4374591, Chr19 position 5013982, Chr19 position 5048836, Chr19 position 5048867, Chr19 position 5048877, Chr19 position 8367279, Chr19 position 8428573, Chr19 position 10254577, Chr19 position 10254578, Chr19 position 10463956, Chr19 position 10464137, Chr19 position 13203671, Chr19 position 13266925, Chr19 position 13266934, Chr19 position 13266970, Chr19 position 13842142, Chr19 position 14248494, Chr19 position 15375465, Chr19 position 17218912, Chr19 position 17346702, Chr19 position 17346702, Chr19 position 18157161, Chr19 position 18157221, Chr19 position 18157258, Chr19 position 18415877, Chr19 position 18415890, Chr19 position 30606642, Chr19 position 35531842, Chr19 position 44303112, Chr19 position 47173037, Chr19 position 47316268, Chr19 position 47778278, Chr19 position 47778298, Chr20 position 34206950, Chr20 position 36771969, Chr20 position 48993661, Chr20 position 58406398, Chr20 position 61976049, Chr20 position 61976073, Chr20 position 62588571, Chr20 position 62588579, Chr22 position 19738127, Chr22 position 35965176, Chr22 position 36549809, Chr22 position 36973375, Chr22 position 37447953, Chr22 position 37914998, Chr22 position 38307317, Chr22 position 39662794, and Chr22 position 45622980.

In embodiments, a method provided herein is practiced for a subject more than once over time. In embodiments, methylation or unmethylation of thyroid nodule DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method includes: (i) isolating DNA from multiple cells of a thyroid nodule of the subject thereby forming a plurality of isolated thyroid nodule DNA molecules, (ii) contacting the plurality of isolated thyroid nodule DNA molecules with a bisulfite salt thereby forming a plurality of reacted thyroid nodule DNA molecules, (iii) detecting the proportion of DNA molecules in the plurality of reacted thyroid nodule DNA molecules having a uracil at a methylation site set forth in Table 1, thereby detecting methylation or unmethylation of said thyroid nodule DNA of the subject.

The methylation of a CpG site of interest may vary between individual cells (and even between chromosome pairs of individual cells) in a biological sample. When DNA is obtained from a biological sample and treated with a bisulfite salt to convert unmethylated cytosines to uracils, the bisulfite-treated DNA will typically contain (i) a proportion of DNA molecules with a cytosine at the site of interest (indicating that the site was methylated); and (ii) a proportion of DNA molecules with a uracil at the site of interest (indicating that the site was unmethylated). Since a uracil at a site of interest in bisulfite-treated DNA indicates that the site was unmethylated in the untreated DNA, a thymidine at the corresponding site in an amplicon of the bisulfite-treated DNA (e.g., an amplicon obtained by PCR) also indicates that the site was unmethylated in the untreated DNA.

In embodiments, the level of methylation at a site of interest is the proportion of bisulfite-treated DNA molecules having a cytosine rather than a uracil at that site of interest. In embodiments, the level of methylation at a site of interest is the proportion of amplicons of bisulfite-treated DNA molecules having a cytosine rather than a thymidine at that site of interest.

In embodiments, the level of unmethylation at a site of interest is the proportion of bisulfite-treated DNA molecules having a uracil rather than a cytosine at that site of interest. In embodiments, the level of unmethylation at a site of interest is the proportion of amplicons of bisulfite-treated DNA molecules having a thymidine rather than a cytosine at that site of interest. In Table 1, an indicated level of uracil is the proportion of bisulfite-treated DNA molecules having a uracil rather than a cytosine at the specified methylation site. The same levels listed in Table 1 also apply to the thymidine levels at a site of interest in an amplicon, i.e., the proportion of amplicons (derived from the PCR amplification of bisulfite-treated DNA molecules) having a thymidine rather than a cytosine at the specified methylation site.

The level of DNA methylation at a site of interest (e.g., a methylation site listed in Table 1) may be determined using sequencing technology. Sequencing technology can reveal nucleotide sequence variations in a plurality of DNA molecules at a single nucleotide base resolution. For example, the proportions of corresponding DNA molecules having a uracil, a thymidine, and/or a cytosine at a site may be determined. A non-limiting example of a sequencing-based method for determining the methylation level at a site of interest is described in Masser et al. (2015) Targeted DNA Methylation Analysis by Next-generation Sequencing, J Vis Exp. (96): 52488, the entire content of which is incorporated herein by reference.

The chromosomal positions listed in Tables 1-4 relate to the human genome that is publically accessible in the University of California Santa Cruz (UCSC) genome browser database under accession number HG19, the entire content of which is incorporated herein by reference in its entirety. Non-limiting information regarding the UCSC Genome Browser is provided in Kent W J, Sugnet C W, Furey T S, Roskin K M, Pringle T H, Zahler A M, Haussler D. The human genome browser at UCSC. Genome Res. 2002 June; 12 (6): 996-1006, the entire content of which is incorporated herein by reference. Each methylation site of interest listed in Table 1 may be located in other human genomes (e.g., within the genome of a specific subject or group of subjects) by replacing every U and R in the corresponding sequence with a C and then searching for the location of the X within a reference genome by aligning the sequence against the reference genome. For example, the methylation site of interest "X" in SEQ ID NO: 1 may be located within a genome by replacing each U and R in SEQ ID NO: 1 with a C (to obtain the pre-bisulfite-modified sequence having an X at the site of interest) and then aligning the sequence against the genome using a BLAST algorithm. Also expressly provided, disclosed, and incorporated herein is the non-bisulfite-modified sequence corresponding to each of SEQ ID NOS: 1-550. The non-bisulfite-modified sequence corresponding to each of SEQ ID NOS: 1-550 is each respective sequence in which each U and R is replaced with a C, where X is the methylation site of interest. For example, the non-bisulfite-modified sequence corresponding to SEQ ID NO: 1 provided herein is a modified version of SEQ ID NO:1 in which each U and R in SEQ ID NO: 1 is replaced with a C, where X is the methylation site of interest; the non-bisulfite-modified sequence corresponding to SEQ ID NO:2 provided herein is a modified version of SEQ ID NO: 2 in which each U and R in SEQ ID NO:2 is replaced with a C, where X is the methylation site of interest; the non-bisulfite-modified sequence corresponding to SEQ ID NO:3 provided herein is a modified version of SEQ ID NO:3 in which each U and R in SEQ ID NO:3 is replaced with a C, where X is the methylation site of interest, and so on.

TABLE 1

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr1 | 2996653 | N/A | 88.84 | N/A | 1 | 2 |
| chr1 | 11979164 | 89.29 | N/A | N/A | 3 | 4 |
| chr1 | 12655938 | N/A | N/A | 69.23 | 5 | 6 |
| chr1 | 16450525 | 70.00 | N/A | N/A | 7 | 8 |
| chr1 | 16450542 | 72.00 | N/A | N/A | 7 | 8 |
| chr1 | 16450545 | 73.33 | N/A | N/A | 7 | 8 |
| chr1 | 16469987 | 80.00 | N/A | N/A | 9 | 10 |
| chr1 | 17494491 | 86.00 | N/A | N/A | 11 | 12 |
| chr1 | 25473203 | 88.89 | N/A | N/A | 13 | 14 |
| chr1 | 27640460 | N/A | 80.56 | N/A | 15 | 16 |
| chr1 | 29565080 | N/A | N/A | 60.00 | 17 | 18 |
| chr1 | 38493013 | 86.36 | N/A | N/A | 19 | 20 |
| chr1 | 38493030 | 79.17 | N/A | N/A | 19 | 20 |
| chr1 | 38493074 | 80.95 | N/A | N/A | 19 | 20 |
| chr1 | 46713777 | N/A | N/A | 73.33 | 21 | 22 |
| chr1 | 46914121 | N/A | N/A | 60.00 | 23 | 24 |
| chr1 | 46955744 | N/A | N/A | 77.78 | 25 | 26 |
| chr1 | 55008344 | N/A | N/A | 60.00 | 27 | 28 |
| chr1 | 109816092 | 80.77 | N/A | N/A | 29 | 30 |
| chr1 | 109816111 | 80.77 | N/A | N/A | 29 | 30 |
| chr1 | 110074669 | 75.00 | N/A | N/A | 31 | 32 |
| chr1 | 110074681 | 71.43 | N/A | N/A | 31 | 32 |
| chr1 | 110074685 | 63.16 | N/A | N/A | 31 | 32 |
| chr1 | 150949856 | 89.29 | N/A | N/A | 33 | 34 |
| chr1 | 150949857 | 88.46 | N/A | N/A | 33 | 34 |
| chr1 | 153540282 | 78.26 | N/A | N/A | 35 | 36 |
| chr1 | 155162704 | 84.21 | N/A | N/A | 37 | 38 |
| chr1 | 155162714 | 88.64 | N/A | N/A | 37 | 38 |
| chr1 | 156676611 | N/A | N/A | 84.62 | 39 | 40 |
| chr1 | 157611881 | 83.05 | N/A | N/A | 41 | 42 |
| chr1 | 182205324 | 77.50 | N/A | N/A | 43 | 44 |
| chr1 | 204118999 | 59.09 | N/A | N/A | 45 | 46 |
| chr1 | 206741875 | 83.33 | N/A | N/A | 47 | 48 |
| chr1 | 206741989 | 66.67 | N/A | N/A | 49 | 50 |
| chr1 | 212587673 | N/A | N/A | 80.00 | 51 | 52 |
| chr1 | 212841198 | 85.29 | N/A | N/A | 53 | 54 |
| chr1 | 223403952 | 79.17 | N/A | N/A | 55 | 56 |
| chr1 | 233430972 | N/A | N/A | 86.67 | 57 | 58 |
| chr1 | 234342767 | 76.67 | N/A | N/A | 59 | 60 |
| chr10 | 3929071 | 88.68 | N/A | N/A | 61 | 62 |
| chr10 | 30047012 | 86.84 | N/A | N/A | 63 | 64 |
| chr10 | 79702989 | 83.33 | N/A | N/A | 65 | 66 |
| chr10 | 87984905 | 86.36 | N/A | N/A | 67 | 68 |
| chr10 | 94838789 | 63.33 | N/A | N/A | 69 | 70 |
| chr10 | 102131187 | 90.00 | N/A | N/A | 71 | 72 |
| chr10 | 104196489 | 75.00 | N/A | N/A | 73 | 74 |
| chr10 | 111766879 | 89.47 | N/A | N/A | 75 | 76 |
| chr10 | 112258886 | 81.82 | N/A | N/A | 77 | 78 |
| chr10 | 112258984 | 83.33 | N/A | N/A | 79 | 80 |
| chr10 | 112259015 | 82.61 | N/A | N/A | 79 | 80 |
| chr10 | 116391763 | N/A | N/A | 75.00 | 81 | 82 |
| chr10 | 120011530 | 79.55 | N/A | N/A | 83 | 84 |
| chr10 | 126172714 | N/A | 80.00 | N/A | 85 | 86 |
| chr10 | 126172747 | N/A | 84.62 | N/A | 85 | 86 |
| chr11 | 556355 | N/A | N/A | 75.00 | 87 | 88 |
| chr11 | 821282 | 89.13 | N/A | N/A | 89 | 90 |
| chr11 | 12188937 | 83.33 | N/A | N/A | 91 | 92 |
| chr11 | 12188948 | 77.78 | N/A | N/A | 91 | 92 |
| chr11 | 12188995 | 78.57 | N/A | N/A | 93 | 94 |
| chr11 | 36057726 | N/A | 79.63 | N/A | 95 | 96 |
| chr11 | 48070143 | N/A | 84.38 | N/A | 97 | 98 |
| chr11 | 48070163 | N/A | 87.50 | N/A | 97 | 98 |
| chr11 | 48070166 | N/A | 84.38 | N/A | 97 | 98 |
| chr11 | 48070174 | N/A | 84.48 | N/A | 97 | 98 |
| chr11 | 65158294 | 78.00 | N/A | N/A | 99 | 100 |
| chr11 | 65158342 | 85.00 | N/A | N/A | 99 | 100 |
| chr11 | 65297089 | 75.00 | N/A | N/A | 101 | 102 |

TABLE 1-continued

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr11 | 66104481 | 81.58 | N/A | N/A | 103 | 104 |
| chr11 | 66104485 | 83.33 | N/A | N/A | 103 | 104 |
| chr11 | 66104578 | 81.82 | N/A | N/A | 105 | 106 |
| chr11 | 68608767 | N/A | N/A | 73.33 | 107 | 108 |
| chr11 | 70236292 | 89.29 | N/A | N/A | 109 | 110 |
| chr11 | 70236320 | 85.71 | N/A | N/A | 109 | 110 |
| chr11 | 70236331 | 70.83 | N/A | N/A | 109 | 110 |
| chr11 | 115530032 | N/A | N/A | 79.49 | 111 | 112 |
| chr11 | 117950310 | 79.55 | N/A | N/A | 113 | 114 |
| chr11 | 117950329 | 79.55 | N/A | N/A | 113 | 114 |
| chr11 | 117950361 | 80.00 | N/A | N/A | 115 | 116 |
| chr11 | 117950362 | 81.82 | N/A | N/A | 115 | 116 |
| chr11 | 119293593 | N/A | N/A | 60.00 | 117 | 118 |
| chr12 | 679803 | 86.84 | N/A | N/A | 119 | 120 |
| chr12 | 26039132 | 73.91 | N/A | N/A | 121 | 122 |
| chr12 | 31004558 | N/A | N/A | 81.82 | 123 | 124 |
| chr12 | 45610695 | N/A | N/A | 83.33 | 125 | 126 |
| chr12 | 45610701 | N/A | N/A | 86.67 | 125 | 126 |
| chr12 | 45610702 | N/A | N/A | 89.47 | 125 | 126 |
| chr12 | 45610706 | N/A | N/A | 80.00 | 125 | 126 |
| chr12 | 50286016 | 82.14 | N/A | N/A | 127 | 128 |
| chr12 | 52243258 | 82.00 | N/A | N/A | 129 | 130 |
| chr12 | 52243286 | 82.50 | N/A | N/A | 129 | 130 |
| chr12 | 54145732 | N/A | N/A | 82.35 | 131 | 132 |
| chr12 | 54145741 | N/A | N/A | 76.47 | 131 | 132 |
| chr12 | 54145825 | N/A | N/A | 70.59 | 131 | 132 |
| chr12 | 56115043 | 89.29 | N/A | N/A | 133 | 134 |
| chr12 | 66262229 | 72.22 | N/A | N/A | 135 | 136 |
| chr12 | 66262230 | 71.74 | N/A | N/A | 135 | 136 |
| chr12 | 66262233 | 68.27 | N/A | N/A | 135 | 136 |
| chr12 | 66262234 | 71.74 | N/A | N/A | 135 | 136 |
| chr12 | 77266621 | N/A | 73.53 | N/A | 137 | 138 |
| chr12 | 117580102 | 84.62 | N/A | N/A | 139 | 140 |
| chr12 | 123435962 | 63.89 | N/A | N/A | 141 | 142 |
| chr12 | 123436011 | 71.88 | N/A | N/A | 143 | 144 |
| chr12 | 123436065 | 69.44 | N/A | N/A | 143 | 144 |
| chr12 | 123540893 | 77.27 | N/A | N/A | 145 | 146 |
| chr13 | 20735797 | N/A | N/A | 82.35 | 147 | 148 |
| chr13 | 23500419 | N/A | N/A | 68.42 | 149 | 150 |
| chr13 | 46771519 | 67.65 | N/A | N/A | 151 | 152 |
| chr13 | 46771520 | 73.91 | N/A | N/A | 151 | 152 |
| chr13 | 53313426 | N/A | N/A | 60.00 | 153 | 154 |
| chr13 | 113807393 | N/A | N/A | 27.27 | 155 | 156 |
| chr14 | 38599118 | 65.91 | N/A | N/A | 157 | 158 |
| chr14 | 69170010 | 86.36 | N/A | N/A | 159 | 160 |
| chr14 | 75701632 | 68.42 | N/A | N/A | 161 | 162 |
| chr14 | 75701643 | 68.75 | N/A | N/A | 161 | 162 |
| chr14 | 90850454 | N/A | N/A | 54.55 | 163 | 164 |
| chr14 | 97524282 | N/A | 88.89 | N/A | 165 | 166 |
| chr14 | 103541602 | N/A | N/A | 52.00 | 167 | 168 |
| chr14 | 103768055 | 76.09 | N/A | N/A | 169 | 170 |
| chr14 | 104209000 | N/A | 80.77 | N/A | 171 | 172 |
| chr14 | 104209068 | N/A | 83.33 | N/A | 171 | 172 |
| chr14 | 104354645 | 72.92 | N/A | N/A | 173 | 174 |
| chr14 | 104360487 | 83.33 | N/A | N/A | 175 | 176 |
| chr15 | 41068807 | 69.12 | N/A | N/A | 17 | 178 |
| chr15 | 61152225 | 83.33 | N/A | N/A | 179 | 180 |
| chr15 | 61152253 | 86.67 | N/A | N/A | 181 | 182 |
| chr15 | 61152313 | 86.67 | N/A | N/A | 183 | 184 |
| chr15 | 65186440 | N/A | N/A | 55.56 | 185 | 186 |
| chr15 | 68851629 | N/A | N/A | 63.64 | 187 | 188 |
| chr15 | 70667596 | 83.33 | N/A | N/A | 189 | 190 |
| chr15 | 70767206 | 90.00 | N/A | N/A | 191 | 192 |
| chr15 | 75251486 | N/A | N/A | 60.00 | 193 | 194 |
| chr15 | 77984014 | N/A | 88.89 | N/A | 195 | 196 |
| chr15 | 77989064 | 73.53 | N/A | N/A | 197 | 198 |
| chr15 | 83952081 | N/A | N/A | 72.73 | 199 | 200 |

TABLE 1-continued

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr15 | 85402496 | 82.10 | N/A | N/A | 201 | 202 |
| chr15 | 85402497 | 79.49 | N/A | N/A | 201 | 202 |
| chr15 | 99417337 | 88.89 | N/A | N/A | 203 | 204 |
| chr16 | 1231873 | 86.36 | N/A | N/A | 205 | 206 |
| chr16 | 1458639 | N/A | N/A | 75.00 | 207 | 208 |
| chr16 | 3023231 | N/A | 84.00 | N/A | 209 | 210 |
| chr16 | 23135832 | 87.50 | N/A | N/A | 211 | 212 |
| chr16 | 29616265 | 85.71 | N/A | N/A | 213 | 214 |
| chr16 | 31009547 | 84.00 | N/A | N/A | 215 | 216 |
| chr16 | 31009548 | 85.00 | N/A | N/A | 215 | 216 |
| chr16 | 31009590 | 85.00 | N/A | N/A | 215 | 216 |
| chr16 | 57793674 | 80.95 | N/A | N/A | 217 | 218 |
| chr16 | 57793715 | 85.71 | N/A | N/A | 217 | 218 |
| chr16 | 57793727 | 80.95 | N/A | N/A | 217 | 218 |
| chr16 | 70771056 | 68.75 | N/A | N/A | 219 | 220 |
| chr16 | 70771079 | 63.33 | N/A | N/A | 219 | 220 |
| chr16 | 70771141 | 65.79 | N/A | N/A | 219 | 220 |
| chr16 | 77332010 | 72.58 | N/A | N/A | 221 | 222 |
| chr16 | 78540378 | 75.76 | N/A | N/A | 223 | 224 |
| chr16 | 79333435 | N/A | 89.61 | N/A | 225 | 226 |
| chr16 | 84262419 | 87.23 | N/A | N/A | 227 | 228 |
| chr16 | 88701114 | N/A | N/A | 66.67 | 229 | 230 |
| chr16 | 89988308 | N/A | N/A | 83.33 | 231 | 232 |
| chr16 | 89988644 | N/A | N/A | 47.37 | 233 | 234 |
| chr17 | 1509928 | N/A | 88.46 | N/A | 235 | 236 |
| chr17 | 1509945 | N/A | 88.46 | N/A | 235 | 236 |
| chr17 | 1509952 | N/A | 83.93 | N/A | 235 | 236 |
| chr17 | 1509953 | N/A | 85.00 | N/A | 235 | 236 |
| chr17 | 7644013 | N/A | 85.42 | N/A | 237 | 238 |
| chr17 | 16323460 | 85.00 | N/A | N/A | 239 | 240 |
| chr17 | 16323473 | 84.21 | N/A | N/A | 239 | 240 |
| chr17 | 16924561 | 80.36 | N/A | N/A | 241 | 242 |
| chr17 | 16924562 | 75.71 | N/A | N/A | 241 | 242 |
| chr17 | 16924594 | 75.71 | N/A | N/A | 241 | 242 |
| chr17 | 17717918 | 72.73 | N/A | N/A | 243 | 244 |
| chr17 | 17718591 | 84.38 | N/A | N/A | 245 | 246 |
| chr17 | 18139506 | 82.81 | N/A | N/A | 247 | 248 |
| chr17 | 35278031 | N/A | N/A | 28.42 | 249 | 250 |
| chr17 | 39677570 | 71.88 | N/A | N/A | 251 | 252 |
| chr17 | 40826257 | N/A | N/A | 23.81 | 253 | 254 |
| chr17 | 43037426 | N/A | N/A | 33.33 | 255 | 256 |
| chr17 | 43200096 | 77.78 | N/A | N/A | 257 | 258 |
| chr17 | 43200239 | 85.00 | N/A | N/A | 259 | 260 |
| chr17 | 43510142 | N/A | N/A | 81.82 | 261 | 262 |
| chr17 | 47987828 | N/A | N/A | 69.23 | 263 | 264 |
| chr17 | 48178379 | 83.33 | N/A | N/A | 265 | 266 |
| chr17 | 48596391 | N/A | 88.64 | N/A | 267 | 268 |
| chr17 | 48764165 | 88.89 | N/A | N/A | 269 | 270 |
| chr17 | 55701962 | 68.75 | N/A | N/A | 271 | 272 |
| chr17 | 73584599 | N/A | N/A | 60.00 | 273 | 274 |
| chr17 | 73993165 | 90.00 | N/A | N/A | 275 | 276 |
| chr17 | 75827716 | 78.57 | N/A | N/A | 277 | 278 |
| chr17 | 76882243 | 61.54 | N/A | N/A | 279 | 280 |
| chr17 | 78765910 | 88.71 | N/A | N/A | 281 | 282 |
| chr17 | 79544478 | 83.15 | N/A | N/A | 283 | 284 |
| chr17 | 80696474 | 60.00 | N/A | N/A | 285 | 286 |
| chr18 | 19751759 | N/A | N/A | 33.33 | 287 | 288 |
| chr18 | 21440760 | 67.86 | N/A | N/A | 289 | 290 |
| chr18 | 45555437 | 66.18 | N/A | N/A | 291 | 292 |
| chr18 | 45555438 | 73.68 | N/A | N/A | 291 | 292 |
| chr18 | 46547891 | 76.09 | N/A | N/A | 293 | 294 |
| chr18 | 55888885 | 75.47 | N/A | N/A | 295 | 296 |
| chr18 | 56452096 | 90.00 | N/A | N/A | 297 | 298 |
| chr18 | 56452476 | 81.82 | N/A | N/A | 299 | 300 |
| chr18 | 56887181 | N/A | N/A | 60.00 | 301 | 302 |
| chr18 | 76002973 | 81.58 | N/A | N/A | 303 | 304 |
| chr18 | 77331090 | 81.03 | N/A | N/A | 305 | 306 |

TABLE 1-continued

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr19 | 677895 | 85.29 | N/A | N/A | 307 | 308 |
| chr19 | 884044 | 76.92 | N/A | N/A | 309 | 310 |
| chr19 | 884059 | 76.92 | N/A | N/A | 309 | 310 |
| chr19 | 884105 | 84.62 | N/A | N/A | 311 | 312 |
| chr19 | 884115 | 84.62 | N/A | N/A | 311 | 312 |
| chr19 | 1136511 | 86.96 | N/A | N/A | 313 | 314 |
| chr19 | 1177605 | 73.68 | N/A | N/A | 315 | 316 |
| chr19 | 1177612 | 72.73 | N/A | N/A | 315 | 316 |
| chr19 | 1177640 | 81.82 | N/A | N/A | 315 | 316 |
| chr19 | 1860601 | 88.46 | N/A | N/A | 317 | 318 |
| chr19 | 1860607 | 82.81 | N/A | N/A | 317 | 318 |
| chr19 | 2503954 | 90.00 | N/A | N/A | 319 | 320 |
| chr19 | 3434917 | N/A | N/A | 40.00 | 321 | 322 |
| chr19 | 3434921 | N/A | N/A | 42.86 | 321 | 322 |
| chr19 | 3434930 | N/A | N/A | 57.14 | 321 | 322 |
| chr19 | 3434939 | N/A | N/A | 71.43 | 321 | 322 |
| chr19 | 3434952 | N/A | N/A | 71.43 | 321 | 322 |
| chr19 | 3434954 | N/A | N/A | 60.00 | 321 | 322 |
| chr19 | 3434962 | N/A | N/A | 71.43 | 321 | 322 |
| chr19 | 3434964 | N/A | N/A | 71.43 | 321 | 322 |
| chr19 | 3434979 | N/A | N/A | 66.67 | 321 | 322 |
| chr19 | 3434985 | N/A | N/A | 55.56 | 321 | 322 |
| chr19 | 4052713 | 85.56 | N/A | N/A | 323 | 324 |
| chr19 | 4052714 | 85.14 | N/A | N/A | 323 | 324 |
| chr19 | 4052749 | 84.62 | N/A | N/A | 323 | 324 |
| chr19 | 4374591 | 82.14 | N/A | N/A | 325 | 326 |
| chr19 | 5013982 | N/A | 83.33 | N/A | 327 | 328 |
| chr19 | 5048836 | 77.27 | N/A | N/A | 329 | 330 |
| chr19 | 5048867 | 70.59 | N/A | N/A | 329 | 330 |
| chr19 | 5048877 | 73.53 | N/A | N/A | 329 | 330 |
| chr19 | 8367279 | 75.00 | N/A | N/A | 331 | 332 |
| chr19 | 8428573 | N/A | N/A | 75.00 | 333 | 334 |
| chr19 | 10254577 | 76.25 | N/A | N/A | 335 | 336 |
| chr19 | 10254578 | 79.17 | N/A | N/A | 335 | 336 |
| chr19 | 10463956 | N/A | 86.73 | N/A | 337 | 338 |
| chr19 | 10464137 | N/A | 89.29 | N/A | 339 | 340 |
| chr19 | 13203671 | 75.86 | N/A | N/A | 341 | 342 |
| chr19 | 13266925 | N/A | N/A | 66.67 | 343 | 344 |
| chr19 | 13266934 | N/A | N/A | 66.67 | 343 | 344 |
| chr19 | 13266970 | N/A | N/A | 63.64 | 343 | 344 |
| chr19 | 13842142 | N/A | N/A | 76.47 | 345 | 346 |
| chr19 | 14248494 | N/A | N/A | 73.91 | 347 | 348 |
| chr19 | 15375465 | 72.22 | N/A | N/A | 349 | 350 |
| chr19 | 17218912 | 81.25 | N/A | N/A | 351 | 352 |
| chr19 | 17346702 | N/A | N/A | 85.71 | 353 | 354 |
| chr19 | 17346702 | N/A | N/A | 78.95 | 353 | 354 |
| chr19 | 18157161 | 88.24 | N/A | N/A | 355 | 356 |
| chr19 | 18157221 | 86.76 | N/A | N/A | 357 | 358 |
| chr19 | 18157258 | 65.22 | N/A | N/A | 359 | 360 |
| chr19 | 18415877 | N/A | N/A | 47.83 | 361 | 362 |
| chr19 | 18415890 | N/A | N/A | 47.83 | 361 | 362 |
| chr19 | 30606642 | 80.56 | N/A | N/A | 363 | 364 |
| chr19 | 35531842 | N/A | N/A | 83.33 | 365 | 366 |
| chr19 | 44303112 | N/A | N/A | 77.78 | 367 | 368 |
| chr19 | 47173037 | N/A | 88.64 | N/A | 369 | 370 |
| chr19 | 47316268 | 76.67 | N/A | N/A | 371 | 372 |
| chr19 | 47778278 | N/A | N/A | 66.67 | 373 | 374 |
| chr19 | 47778298 | N/A | N/A | 83.33 | 373 | 374 |
| chr2 | 3454277 | N/A | 84.78 | N/A | 375 | 376 |
| chr2 | 8793724 | N/A | 78.57 | N/A | 377 | 378 |
| chr2 | 20412441 | 85.71 | N/A | N/A | 379 | 380 |
| chr2 | 42329402 | N/A | N/A | 78.95 | 381 | 382 |
| chr2 | 42329494 | N/A | N/A | 60.00 | 381 | 382 |
| chr2 | 55289272 | N/A | 75.00 | N/A | 383 | 384 |
| chr2 | 65064865 | 64.71 | N/A | N/A | 385 | 386 |
| chr2 | 70823641 | 79.03 | N/A | N/A | 387 | 388 |
| chr2 | 73143689 | N/A | N/A | 77.78 | 389 | 390 |

TABLE 1-continued

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr2 | 74454110 | 70.00 | N/A | N/A | 391 | 392 |
| chr2 | 122014529 | N/A | 86.36 | N/A | 393 | 394 |
| chr2 | 128158884 | 85.00 | N/A | N/A | 395 | 396 |
| chr2 | 128158910 | 77.50 | N/A | N/A | 395 | 396 |
| chr2 | 203114171 | 79.63 | N/A | N/A | 397 | 398 |
| chr2 | 218221671 | N/A | 85.19 | N/A | 399 | 400 |
| chr2 | 219745335 | N/A | N/A | 81.82 | 401 | 402 |
| chr2 | 238341465 | 86.36 | N/A | N/A | 403 | 404 |
| chr2 | 238341542 | 90.00 | N/A | N/A | 405 | 406 |
| chr2 | 238341546 | 87.50 | N/A | N/A | 405 | 406 |
| chr2 | 238774763 | 67.57 | N/A | N/A | 407 | 408 |
| chr20 | 31126186 | 87.50 | N/A | N/A | 409 | 410 |
| chr20 | 31126189 | 84.21 | N/A | N/A | 409 | 410 |
| chr20 | 34206950 | N/A | N/A | 76.47 | 411 | 412 |
| chr20 | 36771969 | 79.31 | N/A | N/A | 413 | 414 |
| chr20 | 48993661 | 80.00 | N/A | N/A | 415 | 416 |
| chr20 | 58406398 | 89.66 | N/A | N/A | 417 | 418 |
| chr20 | 61976049 | 87.93 | N/A | N/A | 419 | 420 |
| chr20 | 61976073 | 89.66 | N/A | N/A | 419 | 420 |
| chr20 | 62588571 | N/A | N/A | 50.00 | 421 | 422 |
| chr20 | 62588579 | N/A | N/A | 38.46 | 421 | 422 |
| chr22 | 19738127 | 70.59 | N/A | N/A | 423 | 424 |
| chr22 | 35965176 | 76.32 | N/A | N/A | 425 | 426 |
| chr22 | 36549809 | 83.33 | N/A | N/A | 427 | 428 |
| chr22 | 36973375 | 80.43 | N/A | N/A | 429 | 430 |
| chr22 | 37447953 | N/A | N/A | 73.33 | 431 | 432 |
| chr22 | 37914998 | N/A | N/A | 69.23 | 433 | 434 |
| chr22 | 38307317 | N/A | 89.66 | N/A | 435 | 436 |
| chr22 | 39662794 | 84.62 | N/A | N/A | 437 | 438 |
| chr22 | 45622980 | 85.00 | N/A | N/A | 439 | 440 |
| chr3 | 13323642 | N/A | N/A | 72.73 | 441 | 442 |
| chr3 | 14180153 | 57.89 | N/A | N/A | 443 | 444 |
| chr3 | 45209073 | N/A | N/A | 60.00 | 445 | 446 |
| chr3 | 45209207 | N/A | N/A | 83.33 | 447 | 448 |
| chr3 | 52525100 | 79.41 | N/A | N/A | 449 | 450 |
| chr3 | 62589658 | 87.50 | N/A | N/A | 451 | 452 |
| chr3 | 65388317 | 71.43 | N/A | N/A | 453 | 454 |
| chr3 | 65388388 | 79.31 | N/A | N/A | 455 | 456 |
| chr3 | 73599302 | 85.11 | N/A | N/A | 457 | 458 |
| chr3 | 195636893 | N/A | N/A | 84.62 | 459 | 460 |
| chr3 | 197093846 | 80.00 | N/A | N/A | 461 | 462 |
| chr4 | 3743223 | 68.18 | N/A | N/A | 463 | 464 |
| chr4 | 5755716 | 85.48 | N/A | N/A | 465 | 466 |
| chr4 | 5755717 | 80.00 | N/A | N/A | 465 | 466 |
| chr4 | 5755728 | 82.26 | N/A | N/A | 465 | 466 |
| chr4 | 5755729 | 79.17 | N/A | N/A | 465 | 466 |
| chr4 | 5755734 | 79.17 | N/A | N/A | 465 | 466 |
| chr4 | 8372861 | N/A | 85.71 | N/A | 467 | 468 |
| chr4 | 57548289 | 80.23 | N/A | N/A | 469 | 470 |
| chr5 | 1118280 | 73.08 | N/A | N/A | 471 | 472 |
| chr5 | 34564389 | 89.29 | N/A | N/A | 473 | 474 |
| chr5 | 73871907 | 89.47 | N/A | N/A | 475 | 476 |
| chr5 | 78013596 | 70.00 | N/A | N/A | 477 | 478 |
| chr5 | 78013643 | 80.00 | N/A | N/A | 479 | 480 |
| chr5 | 137802650 | 72.73 | N/A | N/A | 481 | 482 |
| chr5 | 139051189 | 84.09 | N/A | N/A | 483 | 484 |
| chr5 | 167838221 | 68.18 | N/A | N/A | 485 | 486 |
| chr5 | 177541401 | N/A | N/A | 69.23 | 487 | 488 |
| chr5 | 180018672 | N/A | N/A | 72.73 | 489 | 490 |
| chr5 | 180101026 | N/A | N/A | 64.71 | 491 | 492 |
| chr6 | 3394325 | N/A | 87.84 | N/A | 493 | 494 |
| chr6 | 3887581 | N/A | 85.71 | N/A | 495 | 496 |
| chr6 | 7236568 | 84.43 | N/A | N/A | 497 | 498 |
| chr6 | 7728692 | N/A | N/A | 73.33 | 499 | 500 |
| chr6 | 34203617 | N/A | N/A | 45.45 | 501 | 502 |
| chr6 | 37751320 | N/A | N/A | 78.57 | 503 | 504 |
| chr6 | 41410682 | N/A | N/A | 77.78 | 505 | 506 |

TABLE 1-continued

| Chromosome (chr) | Chr Position | Uracil level in reacted thyroid nodule DNA from cancer tissues is above indicated level* | Uracil level in reacted thyroid nodule DNA from benign tissues is above indicated level* | Uracil level in reacted thyroid nodule DNA from benign tissues is below indicated level* | SEQ ID NO: Forward Strand | SEQ ID NO: Reverse Strand |
|---|---|---|---|---|---|---|
| chr6 | 41438516 | N/A | N/A | 39.13 | 507 | 508 |
| chr6 | 41438575 | 89.66 | N/A | N/A | 507 | 508 |
| chr6 | 43464150 | 75.76 | N/A | N/A | 509 | 510 |
| chr6 | 158734279 | N/A | 86.84 | N/A | 511 | 512 |
| chr7 | 989235 | 76.67 | N/A | N/A | 513 | 514 |
| chr7 | 2673543 | 82.14 | N/A | N/A | 515 | 516 |
| chr7 | 73508602 | N/A | N/A | 85.71 | 517 | 518 |
| chr7 | 105079565 | 78.75 | N/A | N/A | 519 | 520 |
| chr7 | 105079631 | 71.25 | N/A | N/A | 519 | 520 |
| chr7 | 151425103 | 86.96 | N/A | N/A | 521 | 522 |
| chr7 | 151425104 | 76.19 | N/A | N/A | 521 | 522 |
| chr8 | 11764017 | 80.77 | N/A | N/A | 523 | 524 |
| chr8 | 21647308 | N/A | N/A | 71.43 | 525 | 526 |
| chr8 | 22548399 | N/A | 88.16 | N/A | 527 | 528 |
| chr8 | 22548483 | N/A | 87.50 | N/A | 527 | 528 |
| chr8 | 133570537 | N/A | 80.00 | N/A | 529 | 530 |
| chr8 | 141320393 | 75.00 | N/A | N/A | 531 | 532 |
| chr8 | 141320410 | 85.00 | N/A | N/A | 531 | 532 |
| chr9 | 6566568 | 86.84 | N/A | N/A | 533 | 534 |
| chr9 | 16197862 | N/A | 86.36 | N/A | 535 | 536 |
| chr9 | 34591313 | N/A | N/A | 80.00 | 537 | 538 |
| chr9 | 98225096 | N/A | N/A | 22.22 | 539 | 540 |
| chr9 | 126126741 | 86.11 | N/A | N/A | 541 | 542 |
| chr9 | 132083428 | N/A | N/A | 70.59 | 543 | 544 |
| chr9 | 136077410 | 73.91 | N/A | N/A | 545 | 546 |
| chr9 | 139655018 | 83.33 | N/A | N/A | 547 | 548 |
| chr9 | 140205985 | 75.00 | N/A | N/A | 549 | 550 |
| chr9 | 140205985 | 83.33 | N/A | N/A | 549 | 550 |
| chr9 | 140205997 | 79.17 | N/A | N/A | 549 | 550 |

*Level values provided are the proportion (percentage) of reacted thyroid nodule DNA molecules having a uracil at the methylation site of interest. When amplicons generated from reacted thyroid nodule DNA molecules (e.g., by PCR) are used to assess the level of methylation, the values provided correspond to the proportion of amplicons having a thymidine at the nucleotide position that corresponds to the methylation site of interest.

In embodiments, the method of detecting methylation or unmethylation of a thyroid nodule DNA of a subject detects an alteration in methylation including increase or loss of uracil level at plurality of methylation sites. In embodiments, the method of detecting methylation or unmethylation of a thyroid nodule DNA of a subject detects an alteration in methylation including increase or loss of thymidine level at plurality of methylation sites. The indicated levels in Tables 1, 2, 3, and 4, are approximate indicated levels, and include values that are within about 15%, about 10%, or about 5% above and below the indicated levels.

In embodiments, the method detects the uracil level above about a threshold as set forth in Table 2 in subjects with a cancerous thyroid nodule. In embodiments, the method detects the thymidine level above about a threshold as set forth in Table 2 in subjects with a cancerous thyroid nodule.

TABLE 2

Methylation Threshold for Cancerous Thyroid Nodule

| Chromosome | Chromosomal Position | Uracil level in reacted thyroid nodule DNA from cancer tissues is about above indicated level* |
|---|---|---|
| chr1 | 11979164 | 89.29 |
| chr1 | 16450525 | 70.00 |
| chr1 | 16450542 | 72.00 |
| chr1 | 16450545 | 73.33 |
| chr1 | 16469987 | 80.00 |
| chr1 | 17494491 | 86.00 |
| chr1 | 25473203 | 88.89 |
| chr1 | 38493013 | 86.36 |
| chr1 | 38493030 | 79.17 |
| chr1 | 38493074 | 80.95 |
| chr1 | 109816092 | 80.77 |
| chr1 | 109816111 | 80.77 |
| chr1 | 110074669 | 75.00 |
| chr1 | 110074681 | 71.43 |
| chr1 | 110074685 | 63.16 |
| chr1 | 150949856 | 89.29 |
| chr1 | 150949857 | 88.46 |
| chr1 | 153540282 | 78.26 |
| chr1 | 155162704 | 84.21 |
| chr1 | 155162714 | 88.64 |
| chr1 | 157611881 | 83.05 |
| chr1 | 182205324 | 77.50 |
| chr1 | 204118999 | 59.09 |

TABLE 2-continued

Methylation Threshold for Cancerous Thyroid Nodule

| Chromosome | Chromosomal Position | Uracil level in reacted thyroid nodule DNA from cancer tissues is about above indicated level* |
|---|---|---|
| chr1 | 206741875 | 83.33 |
| chr1 | 206741989 | 66.67 |
| chr1 | 212841198 | 85.29 |
| chr1 | 223403952 | 79.17 |
| chr1 | 234342767 | 76.67 |
| chr10 | 3929071 | 88.68 |
| chr10 | 30047012 | 86.84 |
| chr10 | 79702989 | 83.33 |
| chr10 | 87984905 | 86.36 |
| chr10 | 94838789 | 63.33 |
| chr10 | 102131187 | 90.00 |
| chr10 | 104196489 | 75.00 |
| chr10 | 111766879 | 89.47 |
| chr10 | 112258886 | 81.82 |
| chr10 | 112258984 | 83.33 |
| chr10 | 112259015 | 82.61 |
| chr10 | 120011530 | 79.55 |
| chr11 | 821282 | 89.13 |
| chr11 | 12188937 | 83.33 |
| chr11 | 12188948 | 77.78 |
| chr11 | 12188995 | 78.57 |
| chr11 | 65158294 | 78.00 |
| chr11 | 65158342 | 85.00 |
| chr11 | 65297089 | 75.00 |
| chr11 | 66104481 | 81.58 |
| chr11 | 66104485 | 83.33 |
| chr11 | 66104578 | 81.82 |
| chr11 | 70236292 | 89.29 |
| chr11 | 70236320 | 85.71 |
| chr11 | 70236331 | 70.83 |
| chr11 | 117950310 | 79.55 |
| chr11 | 117950329 | 79.55 |
| chr11 | 117950361 | 80.00 |
| chr11 | 117950362 | 81.82 |
| chr12 | 679803 | 86.84 |
| chr12 | 26039132 | 73.91 |
| chr12 | 50286016 | 82.14 |
| chr12 | 52243258 | 82.00 |
| chr12 | 52243286 | 82.50 |
| chr12 | 56115043 | 89.29 |
| chr12 | 66262229 | 72.22 |
| chr12 | 66262230 | 71.74 |
| chr12 | 66262233 | 68.27 |
| chr12 | 66262234 | 71.74 |
| chr12 | 117580102 | 84.62 |
| chr12 | 123435962 | 63.89 |
| chr12 | 123436011 | 71.88 |
| chr12 | 123436065 | 69.44 |
| chr12 | 123540893 | 77.27 |
| chr13 | 46771519 | 67.65 |
| chr13 | 46771520 | 73.91 |
| chr14 | 38599118 | 65.91 |
| chr14 | 69170010 | 86.36 |
| chr14 | 75701632 | 68.42 |
| chr14 | 75701643 | 68.75 |
| chr14 | 103768055 | 76.09 |
| chr14 | 104354645 | 72.92 |
| chr14 | 104360487 | 83.33 |
| chr15 | 41068807 | 69.12 |
| chr15 | 61152225 | 83.33 |
| chr15 | 61152253 | 86.67 |
| chr15 | 61152313 | 86.67 |
| chr15 | 70667596 | 83.33 |
| chr15 | 70767206 | 90.00 |
| chr15 | 77989064 | 73.53 |
| chr15 | 85402496 | 82.10 |
| chr15 | 85402497 | 79.49 |
| chr15 | 99417337 | 88.89 |
| chr16 | 1231873 | 86.36 |
| chr16 | 23135832 | 87.50 |
| chr16 | 29616265 | 85.71 |
| chr16 | 31009547 | 84.00 |
| chr16 | 31009548 | 85.00 |
| chr16 | 31009590 | 85.00 |
| chr16 | 57793674 | 80.95 |
| chr16 | 57793715 | 85.71 |
| chr16 | 57793727 | 80.95 |
| chr16 | 70771056 | 68.75 |
| chr16 | 70771079 | 63.33 |
| chr16 | 70771141 | 65.79 |
| chr16 | 77332010 | 72.58 |
| chr16 | 78540378 | 75.76 |
| chr16 | 84262419 | 87.23 |
| chr17 | 16323460 | 85.00 |
| chr17 | 16323473 | 84.21 |
| chr17 | 16924561 | 80.36 |
| chr17 | 16924562 | 75.71 |
| chr17 | 16924594 | 75.71 |
| chr17 | 17717918 | 72.73 |
| chr17 | 17718591 | 84.38 |
| chr17 | 18139506 | 82.81 |
| chr17 | 39677570 | 71.88 |
| chr17 | 43200096 | 77.78 |
| chr17 | 43200239 | 85.00 |
| chr17 | 48178379 | 83.33 |
| chr17 | 48764165 | 88.89 |
| chr17 | 55701962 | 68.75 |
| chr17 | 73993165 | 90.00 |
| chr17 | 75827716 | 78.57 |
| chr17 | 76882243 | 61.54 |
| chr17 | 78765910 | 88.71 |
| chr17 | 79544478 | 83.15 |
| chr17 | 80696474 | 60.00 |
| chr18 | 21440760 | 67.86 |
| chr18 | 45555437 | 66.18 |
| chr18 | 45555438 | 73.68 |
| chr18 | 46547891 | 76.09 |
| chr18 | 55888885 | 75.47 |
| chr18 | 56452096 | 90.00 |
| chr18 | 56452476 | 81.82 |
| chr18 | 76002973 | 81.58 |
| chr18 | 77331090 | 81.03 |
| chr19 | 677895 | 85.29 |
| chr19 | 884044 | 76.92 |
| chr19 | 884059 | 76.92 |
| chr19 | 884105 | 84.62 |
| chr19 | 884115 | 84.62 |
| chr19 | 1136511 | 86.96 |
| chr19 | 1177605 | 73.68 |
| chr19 | 1177612 | 72.73 |
| chr19 | 1177640 | 81.82 |
| chr19 | 1860601 | 88.46 |
| chr19 | 1860607 | 82.81 |
| chr19 | 2503954 | 90.00 |
| chr19 | 4052713 | 85.56 |
| chr19 | 4052714 | 85.14 |
| chr19 | 4052749 | 84.62 |
| chr19 | 4374591 | 82.14 |
| chr19 | 5048836 | 77.27 |
| chr19 | 5048867 | 70.59 |
| chr19 | 5048877 | 73.53 |
| chr19 | 8367279 | 75.00 |
| chr19 | 10254577 | 76.25 |
| chr19 | 10254578 | 79.17 |
| chr19 | 13203671 | 75.86 |
| chr19 | 15375465 | 72.22 |
| chr19 | 17218912 | 81.25 |
| chr19 | 18157161 | 88.24 |
| chr19 | 18157221 | 86.76 |
| chr19 | 18157258 | 65.22 |
| chr19 | 30606642 | 80.56 |
| chr19 | 47316268 | 76.67 |
| chr2 | 20412441 | 85.71 |
| chr2 | 65064865 | 64.71 |
| chr2 | 70823641 | 79.03 |
| chr2 | 74454110 | 70.00 |

TABLE 2-continued

Methylation Threshold for Cancerous Thyroid Nodule

| Chromosome | Chromosomal Position | Uracil level in reacted thyroid nodule DNA from cancer tissues is about above indicated level* |
|---|---|---|
| chr2 | 128158884 | 85.00 |
| chr2 | 128158910 | 77.50 |
| chr2 | 203114171 | 79.63 |
| chr2 | 238341465 | 86.36 |
| chr2 | 238341542 | 90.00 |
| chr2 | 238341546 | 87.50 |
| chr2 | 238774763 | 67.57 |
| chr20 | 31126186 | 87.50 |
| chr20 | 31126189 | 84.21 |
| chr20 | 36771969 | 79.31 |
| chr20 | 48993661 | 80.00 |
| chr20 | 58406398 | 89.66 |
| chr20 | 61976049 | 87.93 |
| chr20 | 61976073 | 89.66 |
| chr22 | 19738127 | 70.59 |
| chr22 | 35965176 | 76.32 |
| chr22 | 36549809 | 83.33 |
| chr22 | 36973375 | 80.43 |
| chr22 | 39662794 | 84.62 |
| chr22 | 45622980 | 85.00 |
| chr3 | 14180153 | 57.89 |
| chr3 | 52525100 | 79.41 |
| chr3 | 62589658 | 87.50 |
| chr3 | 65388317 | 71.43 |
| chr3 | 65388388 | 79.31 |
| chr3 | 73599302 | 85.11 |
| chr3 | 197093846 | 80.00 |
| chr4 | 3743223 | 68.18 |
| chr4 | 5755716 | 85.48 |
| chr4 | 5755717 | 80.00 |
| chr4 | 5755728 | 82.26 |
| chr4 | 5755729 | 79.17 |
| chr4 | 5755734 | 79.17 |
| chr4 | 57548289 | 80.23 |
| chr5 | 1118280 | 73.08 |
| chr5 | 34564389 | 89.29 |
| chr5 | 73871907 | 89.47 |
| chr5 | 78013596 | 70.00 |
| chr5 | 78013643 | 80.00 |
| chr5 | 137802650 | 72.73 |
| chr5 | 139051189 | 84.09 |
| chr5 | 167838221 | 68.18 |
| chr6 | 7236568 | 84.43 |
| chr6 | 41438575 | 89.66 |
| chr6 | 43464150 | 75.76 |
| chr7 | 989235 | 76.67 |
| chr7 | 2673543 | 82.14 |
| chr7 | 105079565 | 78.75 |
| chr7 | 105079631 | 71.25 |
| chr7 | 151425103 | 86.96 |
| chr7 | 151425104 | 76.19 |
| chr8 | 11764017 | 80.77 |
| chr8 | 141320393 | 75.00 |
| chr8 | 141320410 | 85.00 |
| chr9 | 6566568 | 86.84 |
| chr9 | 126126741 | 86.11 |
| chr9 | 136077410 | 73.91 |
| chr9 | 139655018 | 83.33 |
| chr9 | 140205985 | 75.00 |
| chr9 | 140205989 | 83.33 |
| chr9 | 140205997 | 79.17 |

*Level values provided are the proportion (percentage) of reacted thyroid nodule DNA molecules having a uracil at the methylation site of interest. When amplicons generated from reacted thyroid nodule DNA molecules (e.g., by PCR) are used to assess the level of methylation, the values provided correspond to the proportion of amplicons having a thymidine at the nucleotide position that corresponds to the methylation site of interest.

In embodiments, the uracil level is above a threshold as set forth in Table 3 in subjects with benign thyroid nodules. In embodiments, the thymidine level is above a threshold as set forth in Table 3 in subjects with benign thyroid nodules.

TABLE 3

Threshold for Benign Thyroid Nodule

| Chromosome | Chromosomal Position | Uracil level in reacted thyroid nodule DNA from benign tissues is about above indicated level* |
|---|---|---|
| chr1 | 2996653 | 88.84 |
| chr1 | 27640460 | 80.56 |
| chr10 | 126172714 | 80.00 |
| chr10 | 126172747 | 84.62 |
| chr11 | 36057726 | 79.63 |
| chr11 | 48070143 | 84.38 |
| chr11 | 48070163 | 87.50 |
| chr11 | 48070166 | 84.38 |
| chr11 | 48070174 | 84.48 |
| chr12 | 77266621 | 73.53 |
| chr14 | 97524282 | 88.89 |
| chr14 | 104209000 | 80.77 |
| chr14 | 104209068 | 83.33 |
| chr15 | 77984014 | 88.89 |
| chr16 | 3023231 | 84.00 |
| chr16 | 79333435 | 89.61 |
| chr17 | 1509928 | 88.46 |
| chr17 | 1509945 | 88.46 |
| chr17 | 1509952 | 83.93 |
| chr17 | 1509953 | 85.00 |
| chr17 | 7644013 | 85.42 |
| chr17 | 48596391 | 88.64 |
| chr19 | 5013982 | 83.33 |
| chr19 | 10463956 | 86.73 |
| chr19 | 10464137 | 89.29 |
| chr19 | 47173037 | 88.64 |
| chr2 | 3454277 | 84.78 |
| chr2 | 8793724 | 78.57 |
| chr2 | 55289272 | 75.00 |
| chr2 | 122014529 | 86.36 |
| chr2 | 218221671 | 85.19 |
| chr22 | 38307317 | 89.66 |
| chr4 | 8372861 | 85.71 |
| chr6 | 3394325 | 87.84 |
| chr6 | 3887581 | 85.71 |
| chr6 | 1.59E+08 | 86.84 |
| chr8 | 22548399 | 88.16 |
| chr8 | 22548483 | 87.50 |
| chr8 | 1.34E+08 | 80.00 |
| chr9 | 16197862 | 86.36 |

*Level values provided are the proportion (percentage) of reacted thyroid nodule DNA molecules having a uracil at the methylation site of interest. When amplicons generated from reacted thyroid nodule DNA molecules (e.g., by PCR) are used to assess the level of methylation, the values provided correspond to the proportion of amplicons having a thymidine at the nucleotide position that corresponds to the methylation site of interest.

In embodiments, the uracil level is below a threshold as set forth in Table 4 in subjects with benign thyroid nodule. In embodiments, the thymidine level is below a threshold as set forth in Table 4 in subjects with benign thyroid nodule.

TABLE 4

Methylation Threshold for Benign Thyroid Nodule

| Chromosome | Chromosomal Position | Uracil level in reacted thyroid nodule DNA from benign tissues is about below indicated level* |
|---|---|---|
| chr1 | 12655938 | 69.23 |
| chr1 | 29565080 | 60.00 |
| chr1 | 46713777 | 73.33 |
| chr1 | 46914121 | 60.00 |
| chr1 | 46955744 | 77.78 |
| chr1 | 55008344 | 60.00 |
| chr1 | 156676611 | 84.62 |
| chr1 | 212587673 | 80.00 |
| chr1 | 233430972 | 86.67 |
| chr10 | 116391763 | 75.00 |

TABLE 4-continued

Methylation Threshold for Benign Thyroid Nodule

| Chromosome | Chromosomal Position | Uracil level in reacted thyroid nodule DNA from benign tissues is about below indicated level* |
|---|---|---|
| chr11 | 556355 | 75.00 |
| chr11 | 68608767 | 73.33 |
| chr11 | 115530032 | 79.49 |
| chr11 | 119293593 | 60.00 |
| chr12 | 31004558 | 81.82 |
| chr12 | 45610695 | 83.33 |
| chr12 | 45610701 | 86.67 |
| chr12 | 45610702 | 89.47 |
| chr12 | 45610706 | 80.00 |
| chr12 | 54145732 | 82.35 |
| chr12 | 54145741 | 76.47 |
| chr12 | 54145825 | 70.59 |
| chr13 | 20735797 | 82.35 |
| chr13 | 23500419 | 68.42 |
| chr13 | 53313426 | 60.00 |
| chr13 | 113807393 | 27.27 |
| chr14 | 90850454 | 54.55 |
| chr14 | 103541602 | 52.00 |
| chr15 | 65186440 | 55.56 |
| chr15 | 68851629 | 63.64 |
| chr15 | 75251486 | 60.00 |
| chr15 | 83952081 | 72.73 |
| chr16 | 1458639 | 75.00 |
| chr16 | 88701114 | 66.67 |
| chr16 | 89988308 | 83.33 |
| chr16 | 89988644 | 47.37 |
| chr17 | 35278031 | 28.42 |
| chr17 | 40826257 | 23.81 |
| chr17 | 43037426 | 33.33 |
| chr17 | 43510142 | 81.82 |
| chr17 | 47987828 | 69.23 |
| chr17 | 73584599 | 60.00 |
| chr18 | 19751759 | 33.33 |
| chr18 | 56887181 | 60.00 |
| chr19 | 3434917 | 40.00 |
| chr19 | 3434921 | 42.86 |
| chr19 | 3434930 | 57.14 |
| chr19 | 3434939 | 71.43 |
| chr19 | 3434952 | 71.43 |
| chr19 | 3434954 | 60.00 |
| chr19 | 3434962 | 71.43 |
| chr19 | 3434964 | 71.43 |
| chr19 | 3434979 | 66.67 |
| chr19 | 3434985 | 55.56 |
| chr19 | 8428573 | 75.00 |
| chr19 | 13266925 | 66.67 |
| chr19 | 13266934 | 66.67 |
| chr19 | 13266970 | 63.64 |
| chr19 | 13842142 | 76.47 |
| chr19 | 14248494 | 73.91 |
| chr19 | 17346702 | 85.71 |
| chr19 | 17346735 | 78.95 |
| chr19 | 18415877 | 47.83 |
| chr19 | 18415890 | 47.83 |
| chr19 | 35531842 | 83.33 |
| chr19 | 44303112 | 77.78 |
| chr19 | 47778278 | 66.67 |
| chr19 | 47778298 | 83.33 |
| chr2 | 42329402 | 78.95 |
| chr2 | 42329494 | 60.00 |
| chr2 | 73143689 | 77.78 |
| chr2 | 219745335 | 81.82 |
| chr20 | 34206950 | 76.47 |
| chr20 | 62588571 | 50.00 |
| chr20 | 62588579 | 38.46 |
| chr22 | 37447953 | 73.33 |
| chr22 | 37914998 | 69.23 |
| chr3 | 13323642 | 72.73 |
| chr3 | 45209073 | 60.00 |
| chr3 | 45209207 | 83.33 |
| chr3 | 195636893 | 84.62 |
| chr5 | 177541401 | 69.23 |
| chr5 | 180018672 | 72.73 |
| chr5 | 180101026 | 64.71 |
| chr6 | 7728692 | 73.33 |
| chr6 | 34203617 | 45.45 |
| chr6 | 37751320 | 78.57 |
| chr6 | 41410682 | 77.78 |
| chr6 | 41438516 | 39.13 |
| chr7 | 73508602 | 85.71 |
| chr8 | 21647308 | 71.43 |
| chr9 | 34591313 | 80.00 |
| chr9 | 98225096 | 22.22 |
| chr9 | 132083428 | 70.59 |

*Level values provided are the proportion (percentage) of reacted thyroid nodule DNA molecules having a uracil at the methylation site of interest. When amplicons generated from reacted thyroid nodule DNA molecules (e.g., by PCR) are used to assess the level of methylation, the values provided correspond to the proportion of amplicons having a thymidine at the nucleotide position that corresponds to the methylation site of interest.

In embodiments, the method of detecting methylation or unmethylation of a thyroid nodule DNA is of a candidate thyroid cancer patient. In embodiments, the subject is suspected of having thyroid cancer. In embodiments, the subject has thyroid cancer.

In embodiments, the method of detecting methylation or unmethylation of a thyroid nodule DNA is based on the level of uracil as set forth Table 2, in which the uracil level above the threshold identifies the thyroid nodule as a cancerous thyroid nodule. In embodiments, the method of detecting methylation or unmethylation of a thyroid nodule DNA is based on a level of thymidine indicated in Table 2, in which the thymidine level above the threshold identifies the thyroid nodule as a cancerous thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method. Non-limiting examples of quantitation methods include sequencing and microarray methods.

In embodiments, the method of detecting methylation or unmethylation of a thyroid nodule DNA is based on the level of uracil as set forth Table 3, in which the uracil level above the threshold identifies the thyroid nodule as a benign thyroid nodule. In embodiments, the method of detecting methylation or unmethylation of a thyroid nodule DNA is based on a level of thymidine indicated in Table 3, in which the thymidine level above the threshold identifies the thyroid nodule as a benign thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of detecting methylation or unmethylation of a thyroid nodule DNA is based on the level of uracil as set forth Table 4, in which the uracil level below the threshold identifies the thyroid nodule as a benign thyroid nodule. In embodiments, the method of detecting methylation or unmethylation of a thyroid nodule DNA is based on a level of thymidine indicated in Table 4, in which the thymidine level below the threshold identifies the thyroid nodule as a benign thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the thyroid nodule is a specimen obtained by biopsy or by surgical resection of a subject.

In embodiments, the subject has undergone thyroid surgery, radiation therapy, radioactive iodine therapy, chemotherapy, thyroid hormone therapy, and administration of an active agent before the subject undergoes the method of detecting methylation or unmethylation of a thyroid nodule DNA.

In embodiments, the method includes a determination of prognosis for local recurrence in thyroid cancer. In embodiments, the method includes determination of prognosis of distant recurrence of thyroid cancer.

In embodiments, the method of detecting DNA methylation level in DNA of thyroid nodule may lead to changes in therapeutic regimen for treating the subject. In embodiments a subject identified as having thyroid cancer may be treated with tyrosine kinase inhibitors.

In embodiments, the active agent administered to a subject before or after detecting the level of methylation or unmethylation is: Cabozantinib-S-Malate, Caprelsa® (Vandetanib), Cometriq® (Cabozantinib-S-Malate), Doxorubicin Hydrochloride, Lenvatinib Mesylate, Lenvima® (Lenvatinib Mesylate), Nexavar® (Sorafenib Tosylate), Sorafenib Tosylate, and/or Vandetanib.

Method of Determining Thyroid Cancer or Risk of Developing Thyroid Cancer

In an aspect, provided herein is a method of determining a thyroid cancer or risk of developing thyroid cancer in a subject in need thereof. The method involves:
  (i) isolating a thyroid nodule DNA molecule from a thyroid nodule of the subject thereby forming an isolated thyroid nodule DNA molecule;
  (ii) contacting the isolated thyroid nodule DNA molecule with a bisulfite salt (such as sodium bisulfite) thereby forming a reacted thyroid nodule DNA molecule; and
  (iii) detecting the presence or absence of uracil in the reacted thyroid nodule DNA molecule at a methylation site set forth in Table 1; thereby detecting the thyroid cancer in the subject.

In an aspect, provided herein is a method of detecting a thyroid cancer or risk of developing thyroid cancer in a subject in need thereof, comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) detecting the level of reacted thyroid nodule DNA molecules in the plurality of reacted thyroid nodule DNA molecules having a uracil at a methylation site set forth in Table 1; thereby detecting the thyroid cancer in the subject.

In an aspect, provided herein is a method of detecting a thyroid cancer or risk of developing thyroid cancer in a subject in need thereof, comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) detecting the presence or absence of uracil in a reacted thyroid nodule DNA molecule at a methylation site set forth in Table 1, thereby detecting methylation or unmethylation of the thyroid nodule DNA molecule of the subject.

In an aspect, provided herein is a method of detecting a thyroid cancer or risk of developing thyroid cancer in a subject in need thereof. The method includes: (i) isolating a thyroid nodule DNA molecule from a thyroid nodule of the subject thereby forming an isolated thyroid nodule DNA molecule, (ii) contacting the isolated thyroid nodule DNA molecule with a bisulfite salt (such as sodium bisulfite) thereby forming a reacted thyroid nodule DNA molecule, (iii) amplifying the reacted thyroid nodule DNA molecule thereby forming a reacted thyroid nodule DNA amplicon molecule, (iv) detecting the presence or absence of thymidine in a reacted thyroid nodule DNA amplicon molecule at a methylation site set forth in Table 1, thereby detecting methylation or unmethylation of the thyroid nodule DNA molecule of the subject. In embodiments, contacting the isolated thyroid nodule DNA with a bisulfite salt comprises adding a solution comprising the bisulfite salt to a solution comprising the isolated single stranded DNA.

In an aspect, provided herein is a method of detecting a thyroid cancer or risk of developing thyroid cancer in a subject in need thereof, comprising (i) isolating a plurality of thyroid nodule DNA molecules from the thyroid nodule of the subject thereby forming a plurality of isolated thyroid nodule DNA molecules, (ii) contacting the plurality of isolated thyroid nodule DNA molecules with the bisulfite salt thereby forming a plurality of reacted thyroid nodule DNA molecules, (iii) amplifying the plurality of reacted thyroid nodule DNA molecules thereby forming a plurality of reacted thyroid nodule DNA amplicon molecules, (iv) detecting one or more thyroid nodule DNA amplicon molecules within the plurality of reacted thyroid nodule DNA amplicon molecules having a thymidine at a methylation site set forth in Table 1, thereby detecting methylation or unmethylation of the thyroid nodule DNA molecule of the subject.

In embodiments, detecting one or more thyroid nodule DNA amplicon molecules comprises detecting the level of one or more one or more thyroid nodule DNA amplicon molecules. In embodiments, detecting one or more thyroid nodule DNA amplicon molecules comprises detecting the level of reacted thyroid nodule DNA amplicon molecules in the plurality of reacted thyroid nodule DNA amplicon molecules having a thymidine at a methylation site set forth in Table 1, thereby detecting the level of methylation or unmethylation in the plurality of thyroid nodule DNA molecules of the subject.

In embodiments, detecting a level includes determining the number (e.g. quantitating) or molecules having, e.g., a thymidine or a uracil. In embodiments, detecting a level includes detecting the portion or proportion of a population or plurality of molecules having, e.g., a thymidine or a uracil.

In embodiments, contacting the isolated thyroid nodule DNA with a bisulfite salt comprises adding a solution comprising the bisulfite salt to a solution comprising the isolated thyroid nodule DNA.

In embodiments, the method of determining a thyroid cancer or risk of developing thyroid cancer in a subject in need thereof includes selecting a subject that has or is at risk for developing thyroid cancer. In embodiments, the subject (a) is a woman; (b) is about 20 to about 55 years old; (c) has a mutated Ret Proto-Oncogene; (d) has a grandparent, parent, or sibling who has been diagnosed with thyroid cancer; (e) self-identifies as being Caucasian or Asian; and/or (f) has or has had breast cancer.

In embodiments, the method includes detecting methylation or unmethylation at a plurality of methylation sites set forth in Table 1. In embodiments, the plurality of methylation sites comprises at least about 2, 3, 4, 5, 10, 25, 50, 75, 80, 85, 90, 100, 150, 200, 250, 300, 350, 400, 450, 500, or 550, or 5-550 methylation sites. In embodiments, the plurality of methylation sites comprises less than about 550, 500, 450, 400, 350, 300, 250, 200, 150, 100, 90, 85, 80, 75, 50, 25, or 10 methylation sites. In embodiments, the plurality of methylation sites is about 5, 6, 7, 8, 9, 10, 11, 12, 13, 14, 15, 16, 17, 18, 19, 20, 25, 50, 75, 80, 85, 90, 100, 150, 200, 250, 300, 350, 400, 450, 500, or 550, or 5-550 methylation sites. In embodiments, the plurality of methylation sites includes two or more methylation sites set forth in Table 1 and no other methylation sites.

In embodiments, a method provided herein is practiced for a subject more than once over time. In embodiments, methylation or unmethylation of thyroid nodule DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method of determining a thyroid cancer or risk of developing thyroid cancer in a subject in need thereof includes determining alteration in methylation at a plurality of methylation sites set forth in Table 1. In embodiments, the method comprises: (i) isolating DNA from multiple cells of a thyroid nodule of the subject thereby forming a plurality of isolated thyroid nodule DNA molecules, (ii) contacting the plurality of isolated thyroid nodule DNA molecules with a bisulfite salt thereby forming a plurality of reacted thyroid nodule DNA molecules, (iii) detecting the proportion of DNA molecules in the plurality of reacted thyroid nodule DNA molecules having a uracil at a methylation site set forth in Table 1.

In embodiments, the method of determining a thyroid cancer or risk of developing thyroid cancer in a subject in need thereof includes alteration, i.e., increase or loss of uracil level at plurality of methylation sites. In embodiments, the method of determining a thyroid cancer or risk of developing thyroid cancer in a subject in need thereof includes alteration, i.e., increase or loss of thymidine level at plurality of methylation sites.

In embodiments, the method of determining a thyroid cancer or risk of developing thyroid cancer in a subject in need thereof includes determining a uracil level which is above a threshold as set forth in Table 2. In embodiments, the method of determining a thyroid cancer or risk of developing thyroid cancer in a subject in need thereof includes determining a thymidine level which is above a threshold indicated in Table 2. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer in a subject in need thereof includes determining a uracil level which is above a threshold as set forth in Table 3. In embodiments, the method of determining a thyroid cancer or risk of developing thyroid cancer in a subject in need thereof includes determining a thymidine level which is above a threshold indicated in Table 3. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer in a subject in need thereof includes determining a uracil level which is below a threshold as set forth in Table 4. In embodiments, the method of determining a thyroid cancer or risk of developing thyroid cancer in a subject in need thereof includes determining a thymidine level which is below a threshold indicated in Table 4. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer involves a candidate thyroid cancer patient. In embodiments, the subject is suspected of having thyroid cancer. In embodiments, the subject has thyroid cancer.

In embodiments, the method of determining a thyroid cancer or risk of developing thyroid cancer in a subject in need thereof includes determining a uracil level in which a threshold above the threshold set forth in Table 2 identifies the thyroid nodule as a cancerous thyroid nodule. In embodiments, the method of determining a thyroid cancer or risk of developing thyroid cancer in a subject in need thereof includes determining a thymidine level in which a threshold above the threshold indicated in Table 2 identifies the thyroid nodule as a cancerous thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer in a subject in need thereof includes determining a uracil level in which a threshold above the threshold set forth in Table 3 identifies the thyroid nodule as a benign thyroid nodule. In embodiments, the method of determining a thyroid cancer or risk of developing thyroid cancer in a subject in need thereof includes determining a thymidine level in which a threshold above the threshold indicated in Table 3 identifies the thyroid nodule as a benign thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer in a subject in need thereof includes determining a uracil level in which a threshold below the threshold set forth in Table 4 identifies the thyroid nodule as a benign thyroid nodule. In embodiments, the method of determining a thyroid cancer or risk of developing thyroid cancer in a subject in need thereof includes determining a thymidine level in which a threshold below the threshold indicated in Table 4 identifies the thyroid nodule as a benign thyroid nodule. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of determining a thyroid cancer or risk of developing thyroid cancer in a subject in need thereof includes determining a uracil level in DNA of a thyroid nodule specimen obtained by biopsy or by surgical resection of a subject. In embodiments, the method of determining a thyroid cancer or risk of developing thyroid cancer in a subject in need thereof includes determining a thymidine level in DNA of a thyroid nodule specimen obtained by biopsy or by surgical resection of a subject.

In embodiments, the method of determining a thyroid cancer or risk of developing thyroid cancer is of a subject who has previously undergone thyroid surgery, radiation therapy, radioactive iodine therapy, chemotherapy, thyroid hormone therapy, and/or administration of an active agent, before the determination.

In embodiments, a subject having thyroid cancer or at risk of developing thyroid cancer was administered an active agent: Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and/or Vandetanib.

In embodiments, the method of determining a thyroid cancer may lead to changes in therapeutic regimen for treating the subject. In embodiments a subject identified as having thyroid cancer may be treated with tyrosine kinase inhibitors. In embodiments, a subject identified as having thyroid cancer or being at risk of developing thyroid cancer according to a method disclosed herein is advised and/or directed to receive additional screening and/or treatment for thyroid cancer.

In embodiments, the active agent administered to a subject after determining thyroid cancer is: Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and/or Vandetanib.

Method of Treating Thyroid Cancer

Also provided herein is a method of treating thyroid cancer in a subject by administering to the subject an active agent for treating thyroid cancer, in which the subject is identified for treatment by a method including isolating a thyroid nodule DNA molecule from a thyroid nodule of the subject thereby forming an isolated thyroid nodule DNA molecule; contacting the isolated thyroid nodule DNA molecule with a bisulfite salt (such as sodium bisulfite) thereby forming a reacted thyroid nodule DNA molecule; and detecting the presence or absence of uracil in the reacted thyroid nodule DNA molecule at a methylation site set forth in Table 1; thereby detecting the thyroid cancer in the subject. In embodiments, contacting the isolated thyroid nodule DNA with a bisulfite salt comprises adding a solution comprising the bisulfite salt to a solution comprising the isolated thyroid nodule DNA.

In embodiments, the method includes detecting methylation or unmethylation at a plurality of methylation sites set forth in Table 1. In embodiments, the plurality of methylation sites comprises at least about 2, 3, 4, 5, 10, 25, 50, 75, 80, 85, 90, 100, 150, 200, 250, 300, 350, 400, 450, 500, or 550, or 5-550 methylation sites. In embodiments, the plurality of methylation sites comprises less than about 550, 500, 450, 400, 350, 300, 250, 200, 150, 100, 90, 85, 80, 75, 50, 25, or 10 methylation sites. In embodiments, the plurality of methylation sites is about 5, 6, 7, 8, 9, 10, 11, 12, 13, 14, 15, 16, 17, 18, 19, 20, 25, 50, 75, 80, 85, 90, 100, 150, 200, 250, 300, 350, 400, 450, 500, or 550, or 5-550 methylation sites. In embodiments, the plurality of methylation sites includes two or more methylation sites set forth in Table 1 and no other methylation sites.

In embodiments, a method provided herein is practiced for a subject more than once over time. In embodiments, methylation or unmethylation of thyroid nodule DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method of treating a thyroid cancer in a subject in need thereof includes determining alteration in methylation at a plurality of methylation sites set forth in Table 1.

In embodiments, the method of treating a thyroid cancer in a subject in need thereof includes alteration which includes increase or loss of uracil level at plurality of methylation sites.

In embodiments, the method of treating a thyroid cancer in a subject in need thereof includes determining a uracil level which is above a threshold as set forth in Table 2. In embodiments, the method of treating a thyroid cancer in a subject in need thereof includes determining a thymidine level which is above a threshold indicated in Table 2. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of treating a thyroid cancer in a subject in need thereof includes determining a uracil level which is above a threshold as set forth in Table 3. In embodiments, the method of treating a thyroid cancer in a subject in need thereof includes determining a thymidine level which is above a threshold indicated in Table 3. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of treating a thyroid cancer in a subject in need thereof includes determining a uracil level which is below a threshold as set forth in Table 4. In embodiments, the method of treating a thyroid cancer in a subject in need thereof includes determining a thymidne level which is below a threshold indicated in Table 4. In embodiments, the level is the proportion of molecules (e.g., in a plurality of reacted thyroid nodule DNA molecules or a plurality of reacted thyroid nodule DNA amplicons) having a uracil or thymidine as determined by a quantitation method.

In embodiments, the method of treating a thyroid cancer is in a subject who has undergone surgery, radiation therapy, radioactive iodine therapy, chemotherapy, or thyroid hormone therapy, before the detecting thyroid cancer.

In embodiments, an active agent administered to a subject for treating thyroid cancer: Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and/or Vandetanib.

In embodiments, the subject has or is at risk of papillary thyroid cancer, follicular thyroid cancer, medullary thyroid cancer, or anaplastic thyroid cancer.

In embodiments, the method includes determining a papillary thyroid carcinoma (PTC) methylation alteration score for the subject, wherein the PTC methylation alteration score is equal to the number of methylation sites in Table 1 having a uracil level equal to or greater than the corresponding threshold level set forth in Table 2.

In embodiments, the method includes determining a PTC methylation alteration score for the subject, wherein the PTC methylation alteration score is equal to the number of methylation sites in Table 1 having a thymidine level equal to or greater than the corresponding threshold level set forth in Table 2.

In embodiments, the method includes determining a benign thyroid nodule (BTN) methylation alteration score for said subject, wherein the BTN methylation alteration score is equal to: (a) the number of methylation sites in Table 1 having a uracil level equal to or greater than the corresponding threshold level set forth in Table 3; (b) the number of methylation sites in Table 1 having a uracil level equal to or less than the corresponding threshold level set forth in Table 4; or (c) the number of methylation sites in Table 1 having a uracil level equal to or greater than the corresponding threshold level set forth in Table 3 plus the number of methylation sites in Table 1 having a uracil level equal to or less than the corresponding threshold level set forth in Table 4.

In embodiments, the method includes determining a benign thyroid nodule (BTN) methylation alteration score for said subject, wherein the BTN methylation alteration score is equal to: (a) the number of methylation sites in Table 1 having a thymidine level equal to or greater than the corresponding threshold level set forth in Table 3; (b) the number of methylation sites in Table 1 having a thymidine level equal to or less than the corresponding threshold level set forth in Table 4; or (c) the number of methylation sites in Table 1 having a thymidine level equal to or greater than the corresponding threshold level set forth in Table 3 plus the number of methylation sites in Table 1 having a thymidine level equal to or less than the corresponding threshold level set forth in Table 4.

In embodiments, the method comprises calculating a Composite Cancer Risk Score for the subject. In embodiments, the Composite Cancer Risk Score for the subject equals: [the PTC methylation alteration score for said subject]/[BTN methylation alteration score for said subject]. In embodiments, the Composite Cancer Risk Score for the subject equals: [(the PTC methylation alteration score for said subject)+1]/[(BTN methylation alteration score for said subject)+1].

In embodiments, the subject is identified as being at risk of developing thyroid cancer or diagnosed as having thyroid cancer if (a) the PTC methylation alteration score for the subject is at least 5, 6, 7, 8, 9, or 10; (b) the BTN methylation alteration score for the subject is at least 5, 6, 7, 8, 9, or 10; and/or (c) the Composite Cancer Risk Score for the subject is at least about 2, 2.1, 2.2, 2.3, 2.4, 2.5, 2.6, 2.7, 2.8, 2.9, or 3.0.

In embodiments, the subject receives treatment (e.g., is directed or advised to receive treatment) for thyroid cancer or is directed to receive additional screening for thyroid cancer if (a) the PTC methylation alteration score for the subject is at least 5, 6, 7, 8, 9, or 10; (b) the BTN methylation alteration score for the subject is at least 5, 6, 7, 8, 9, or 10; and/or (c) the Composite Cancer Risk Score for the subject is at least about 2, 2.1, 2.2, 2.3, 2.4, 2.5, 2.6, 2.7, 2.8, 2.9, or 3.0.

Target Sites for Methylation Level of Thyroid Nodule

In another aspect, provided herein is a deoxyribonucleic acid 5 to 100, 5 to 300, 5 to 300, or at least about 5, 50, 100, 150, 200, 250, 300, or more nucleotides in length including a uracil-containing sequence identical to the sequence of at least 5 contiguous nucleotides within a sequence including SEQ ID NO:1 to SEQ ID NO:550.

SEQ ID NO:1 to SEQ ID NO:500 are 300 bp length sequences that include the target sites (i.e., methylation sites of interest). The sequences provided are as modified after bisulfite conversion. Therefore "C" in the non-CpG context becomes "U", and C in the CpG context is designated as R or X (either "U" either "C"), where X is the target site. The DNA strands (sense and antisense) are no longer complementary after bisulfite conversion. Therefore, each DNA strand is identified with its unique sequence, and is designated as "forward" and "reverse" respectively, in Table 1.

5 The sequences listed in Table 1 are provided below with their respective sequence identification number.

| SEQ ID NO: | Sequence |
|---|---|
| 1 | TUUTTAGUUUTURGTGGRGUUAGAGTTGGTTGUUTUAGTAGRGRGTGUUUAUURGG UUUAAAGUTGTTUTGUAGUTGGTUAUTGTGGGAGAAGAGAUTGGAAAAGTTUAAAG GTGGAGAGGRGGUAGRGATUTGGAGUAUTTTTURGUAXGUTGTAAUUUUTGAGAAG AAAUAAAGAGGAAARGAGGGUTGTTTAGATAAUUURGGGUUUTGGTGUTTGUATTTA GAAAAATTAGGUUUTUTGAAAAATTAUAGAATTATGUTGUUAGTGTUAGGTTUUU AGATAATGATGTGTUTGTGT |
| 2 | UAUAGAUAUATUATTATUTGGGAAUUTGAUAUTGGUAGUATAATTUTGTAATTTTT UAAGAGGGUUTAATTTTTUTAAATGUAAGUAUUAGGGUURGGGATTATUTAAAUAG UUTRGTTTUUTUTTTGTTTUTTUTUAGGGGTTAUAGXGTGRGGAAAAGTGUTUUAGA TRGUTGURGUUTUTUUAUUTTTGAAUTTTTUUAGTUTUTTUTUUUAUAGTGAUUAGU TGUAGAAUAGUTTTGGGURGGGTGGGUARGRGUTAUTGAGGUAAUUAAUTUTGGRG UUARGGAGGGUTAAGGAU |
| 3 | GGGTGAUUAGTGUUAUTAAAAGUAGAGUTTGAGTTTAUTUTUATAAUUATRGGUTG TGGGUUAGAUATTTGGUTGUTTTGUAGGUAGAUUAGGUTTUURGGTGAGTUATGUT GUTTAAAATGUTGTUTGGGAARGUAGAGAAAGTUTAAAXGUUAAGARGUTGAGGA UAGUUURGUAGGTGGAUTGUUATGUURGGUTRGGUUUUTTTTGGTUUUUAGAGTG GAUUUTTUTUUTUUUUAUAGAGGGGAGGUATUTGATGGTGGUTTUAGUAGAUAAU UTGGAGAAGAAUUAUTUAGGGT |
| 4 | AUUUTGAGTGGTTUTTUTUUAGGTTGTUTGUTGAAGUAUUATUAGATGUUTUUUU TUTGTGGGAGGAGAAGGGTUUAUTUTGGGGAUUAAAAAGGGGURGAGURGGGUA TGGUAGTUUAUUTGRGGGGUTGTUUTUAGRGTUTTGGXGTTTAGAUTTTUTUTGRGT TUUUAGAUAGUATTTAAGUAGUATGAUTUAURGGGAAGUUTGGTUTGUUTGUAAA GUAGUUAAATGTUTGGUUUAUAGURGATGGTTATGAGAGTAAAUTAAGUTUTGUT TTTAGTGGUAUTGGTUAUUU |

| SEQ ID NO: | Sequence |
|---|---|
| 5 | CAGUTGGGGAGGGGAUAGGGUAGGUGGUTGUAGAAGGGGGUTGGGUUGAGGTUTU<br>AGGTGUAGARGAGGAGGGGUUGGGRGGAGGGGGUGAGGAGGGGAGURGGGUUGGG<br>GGURGGGRGRGUTGUTGGGGUUUUUUUUURGUUURGGGAUXGTURGUTUTTGUUUA<br>GAUURGTRGGUAAAUAGARGURGTGAUGUUARGGGRGURGUUGAUUUGUGGUUGAA<br>UURGGAGUUGUAAATGAGAUGUAAGGUGUUAGUAGUUUUARGGURGUAGGGUUTAR<br>GAGUUAUARGRGUUUUUURGURGG |
| 6 | URGGRGGAGGAGRGRGTGTGGUURGUUAGGUUUUUGRGGURGGAGGUUGUUGGUAUUU<br>UGUAUUUUAUUUAUAGUUURGGGUUAGUUUAUAGGUUAGRGGRUUURGUGAUAUUA<br>RGGRGUTUTGUUUAURGARGGGUUUGGGUAAGAGRGGAXGGUUURGGGGRGGGAGGG<br>GGAUUUUAGUAGRGUUURGGUUUUUAGUURGGUUUUUUUUUUUAUUUUUUUURGUU<br>UAGUUUUUUUUUTRGUUGUAUUUGAGAUUUUAAUUUAGUUUUUTTUTGUAGUUAUU<br>UAUUUUGUUUUUUUUUAGUUG |
| 7 | TTTUUGTAAAAUGGGGURGUUUAUAAAAUUAAUAAAGUGTUGAGGUUURGAU<br>AAGURGAAAUUGUGAAAAGUUGUGUAAAUUUAGAGUGUAUAUGGAUGGUUGA<br>AGGGAUAUUAUUGAUAGUUGGGGAGUXGUGGAGGGAAGUUGAXGGXGUGUTUT<br>GUTGUUUTUUUAUUUUUAGUUUUUURGAAGAUTUTGAGUAGUUGGAGAUAAAG<br>GUGAUUGGGGUUUUGGTAUGGAGGURGGGGUTRGGUAGAAUUUGUUUURGGUUUU<br>UUUGUUUAUUUUUUAUUUUAU |
| 8 | GTGGGUGGGAGGUGGGUAGGGGGURGGGAAGUAGGUUUTGURGAGUURGGUUUUU<br>AUGUUAGUAGGUUUUAAUUAUUUUUGAUUUUAGGUGUUUAGAGUUUUGGGAGG<br>GUUGGGAGGUAGGAGAAUAGUAAGAGUXGUXGUUAGUUUUUUUUUUAXGGUUUU<br>RGGAGUGUGRGAAAUAGAUUUUUAAUUAUUUAUGUAUAGUUUUGAGGUUUAUA<br>AGUUUUUAUUAGGUUUTRGGUUGUGUUGGAAUUUAAUAUUUGUUAUGAGUUTUUUGGG<br>GRGGUUUUAUUUUAUAGAAAA |
| 9 | TGAGUAGTGUUUAGRGUUUAGAGAGAUAUUGUGGAGAAGGUUUAUUAGGAUGUU<br>TAUUGUUUAUAUAAGAGUUUAAUUUUGGUAUAUUUGUGGUAUAUUUGUGGAGAG<br>UUGUUUUGGUUURGGUUGUUUGGUAGGUUUGGGUUAUUUXGAGUAGGGGAAUUGGG<br>GUAUAGUUGGUGUAUUUURGGUUAUAUUUGGUUUUUUUAGUUUUUGAGUGUUGGUU<br>UUUUUAGGUGGUAGUAUGAGGUUGAUUUAGGGAUGAGARGUUUUUAUGGUGARGUAAAGU<br>UUAGUUUUUAGUGGAGUUUUT |
| 10 | AGGGGUUUUAUGGGGGUUGGAUUUGRGUUAARGAUAAGGGRGTUUGUUUUGAGUU<br>AUUUAUGUUUGUUAUUGAGGGRGGGUAUGGGAAUUGGAAAAAAUUAGGGUAUA<br>GURGGAGGUGUAGUUAUUGUGUUUUAGUUUUUUUGUTXGGAGUAGGUUUAGGGUUG<br>UUAGAUAAURGGGUUUAGAAUAGUUUUUUAAGGUGUGUUAUAGGUGUGUUAAAAG<br>UTAGGUUUTGUGUAAGGUAGGUAGGGAUAUUUGGUUGGAUUUUUUAUAGUGUUTUT<br>UTGGGRGUUGAAAUAUUGUUUA |
| 11 | TUUUGUAAAAUUUUAGAGUUAGGUAUAUUUAAUrUTGUAARGUGGUAGUUGUAUGA<br>UGUAUAAGUUUUUAAAUAGUAURGGGGUUUAGUGAUAUAUUUGUUAAAUGGGUU<br>GGUGAUGAUAAUGGUUAGUAUUUAUGGAGGAGUUUAUAXGGUGUUAAGUGUUTrAU<br>AUAUAUAGUUAAUGAAUUUUUUAUUGUUGUUAAUGAGAUAGGUAUUAUUGAAUUA<br>GAGGUURGGAGAGAGUUUARGRGGUUGGUUAUAUGGGUGAAGAGUUUGGGUUUAAT<br>GUUUGGUGAAUUTURGGUAU |
| 12 | GTGURGAGAGUUUAUUAGGUAUUGAAUUAAGUGUUUUAUUAGUAUGAUUAAURGRG<br>UGGAGUUUUUURGGGGUUUUGAUUUAAUAGUAUUUGUUUUAUUGGUAGUAGUGAG<br>GAUUUAGUUAGUGAUAUGUGUAAAGUAUUUAGUAUXGUGUGGGGUUUUUUAUAAA<br>UGUUGAUUAUUAUAUAUUAAUUUAUUUAAUAGAUGAUGUAAUGAGGUURGGUG<br>UGUUAAGGGAUUUGUAUAGUUAUGUAGUUAUUARGUUGUAGAAUUGGGUAUAUU<br>GGUUUGUGGAAUUUUAUAAGA |
| 13 | TURGGAGUUAGUGAAUUUGUGAUURGGAGUUAGUUAAUUUAUAGUUAAUGUGUUG<br>AGUAGUAUUUAGUUAGRGUUGAAGUUUAGAGUAGGGGAGGRGGARGGGUUUUAGG<br>AGUUUGAGGUURGGGAAGURGAAGUAUUAUUAAAUUGAGXGAGGUUUUAAUUUTU<br>UUTUUUAGGAGGUURGGUUGUUUUUUAUUAGUAGUUUAAUUAUAGGGGUUUUGUUU<br>UAGARGUUAUUAUUUUUUUUUUUUAGUGUGUUAGUAGUAAAUTRGAUUGUUAAUUA<br>AUAARGUGAAAAAUAAAUUGUAG |
| 14 | UTGUAGUUAUUUUUUARGUUGUUGUUGGUAGURGAGGUUGUGUGGAUAUAUGAA<br>AAAGAGAAAAUAGUAAGUUUGGAGUAGGAUUUGUGGUUGGGUUGUGUGGUGGAG<br>GUAGURGGAUUUUTGGGAGGGAGAGUUGGAAAUUXGUUAGUUUGGUGGUGUUTR<br>GGUUUUURGGAUUUGAAUUUUGGGGUURGUURGUUUUGUUGUUUGGUUUAGA<br>RGUUGGUUGGAAUGUUGUUAGUAUAUUAGUGUUGAAGUUAAAUUGGUUURGGAUUAU<br>UAAGUUUAAUUGGUUURGGA |

| SEQ ID NO: | Sequence |
|---|---|
| 15 | TTGUUAAAAUTGGAAGUAAUUAAGATGUUUUTAAAAGGTGAATGGAGGUUAGGT<br>GRGGTGGUTUARGURGATAAUUUAGUAUTTUGGGAGGUTGAGGUAGGTGGATUAU<br>TTGAGATUARGAGUTTGAGAUUAGUURGGUUAAUATGGXGAAAUUURGTUTUTAUT<br>AAAAATAUUAAGATUAAURGGGRGUGGTGGUARGTGUUTGUUAUUUAGUUAUUG<br>GGAAGUTGAGGUAGGUAAATTGUTTGAAUUTGGGAGGUGGAGGUAUAGUGAGUU<br>AAGATTGUUUAUTGUAUTUUA |
| 16 | TGGAGTGUAGTGGUAUAAUTUTTGGUTUAUTGUGAUUUUAUUUUUAGGTTUAAGU<br>AATTTGUUTGUUTUAGUTUUUAAGUAGUTGGGATAAUAGGUARGTGUUAUUARGU<br>URGGTTAATUTTAGTATTTTTAGTAGAGARGGGGTTTXGUUATGTTGGURGGGUTGG<br>TUTUAAAUTRGTGATUTUAAGTGAUUUAUUTGUUTAGUUTUUUAAAGTGUTGGGA<br>TTATRGGRGTGAGUUAURGUAUUTGGUUTUAUTTAAUUTTTTGAGGGGUAUTTTGGT<br>TGUTTUUAGTTTTGGUAA |
| 17 | GGRGGGAUURGAGURGAGAUARGUGUTGGAGRGGAGURGUTTUUTUARGGTRGUUA<br>GURGUAGAUAAUTGAUUTUUURGGUAUTRGRGUUTRGRGGUUUTGUTGUTGGUUURGG<br>TGTUTRGGGURGGAAUUTUGUUGGUUUAGRGUTRGXGURGGUUAUUGGUUAGRGU<br>TTGGGUUTRGUUUTGUAGUUARGGGGUUAUAGGGUAUAGUTTUAGUTTUGAUUTUU<br>URGTUUURGAAAGGARGUUUAAGGRGAUUUUUAUUUUAUUUUUUUUAAUUTUU<br>UUUUAUGUUUGRGGUAAUUU |
| 18 | AGTTGURGUAGGAUAUGGGGGAGAAGTTGGGGAGGAUGGGGGTGGGAGGTRGUUUTG<br>GGRGTUUTTTGGGAARGGGGAGGUAAAGUUAAAGUTGTGUUUTAUGGUUURGGA<br>GUTGUAGGGRGAGGUUUAAGRGUTGGUUAGTGGURGGXGRGAARGUTGGAGUUAU<br>AGGAGTUURGGUURGAGAUAURGGAGUUAGUAGUAGGUGGURGRGAARGRGATGURG<br>GGGAGGUUAGTUGUUTGRGGUUGGRGAURGTGAGGAAGRGGUUURGUTUUAGUARG<br>TGTUTRGGUTRGGAUURGUUU |
| 19 | UUAGUAGGGAAGGUAGUUAAUAGATGUAGAUTRGUUTUUGUUUAUUUTGUUGGAGGUR<br>GGTGAGGUUAGGGUUTGUTTGGGAUUTGAAAUAGTGAGGUAAGTGGGTGUGUGGTGU<br>TGGGUUUUXGUTUAAGTTUTUUUAGXGUTGUUUAGUUUURGGAGUUUTATGTGUAGG<br>GTGUUTGGGAAGGGXGGGUTGAAUURGUGGTGGGAGUUTTTGGUUAAAAGUUUUUAGG<br>TGAGTGGAGGAATTGGGGRGGAUUTGAAGTAUUTGUUTTGAAGTGGAUUTGGUAGG<br>UUUTUUUTGGGUUTGUGUAGUUTG |
| 20 | UAGUUTGUAUAAGUUUAAGAGGUUUTGUUAGGTLUAUUUTAAGAUAGUAUUTUAGGT<br>URGUUUUUAATTUTTUUAUUTAUUTGGGGUUUTTGAGUUAAGAUUUITUAUUUARGAT<br>TUAGAUXGUUUTTUUUUUAAUAUUUTGUAUUATAAGGUUTUARGGGUAAAUTGGUAXGUTG<br>GGAGAAUTTGAGXGGGGAGUUUAGUAUUAUAUAUUUAUUTGUUTTUAAUTGTTTTUAA<br>GUUUUAAUAGGGUUUTGGUUTAAUURGGUUTUUAAUAGGTAGGUAGAGRGAGUTUTGUA<br>TUTGUTTGGUTGUUTTUUUTGUTGG |
| 21 | UUAGAUTRGUUUTUUUUAUUTRGGGUUTRGGAUUTTUAUUUUAGUTUTUTUTUUTG<br>GUUAGTGAUUAUUUAUUUUUAAUTUUUAUUURGUUUURGURGRGUAAUTAUUTUUTU<br>UUUTUAUURGGAUUGGGAUUAUUAUUTUUAUTUXGUUUAGUTUGGGAUUTU<br>UAUUTGUUTUUTUUUUAAUUUUAUAUTAAUTUTGUUTGGUTUTUUUTUTTTGGUU<br>TAATUTUTRGTUTRGGUTUATTGGGGARGGUUAUTUTUAUAGUTTUGGUTTUAAAAUAU<br>UAGUTUUTGGATGGATTUUU |
| 22 | GGGAAUUUAUUUAGGAAUUGGTGUTTGGAAUUAAAAUTGTGAGAGUTGGURGUTUUUA<br>ATAAGURGAGARGAGAGAUUAGGUUAAAGAGGAAGAGAUUAAGUAGAGAUUAGTG<br>TGGGATUGGGGAGGAGGUAGGUGGAGUUUAGAUTGGGXGGAGUTGGAGUTGGGGAT<br>GATGGUUUUAGTURGGGUUGAAGGGAGGAGGUAGTUTGRGRGGRGGGGRGGGGUGGG<br>ATUGGGGGUTGGGUAAUUAUUGGUUAGGAGAGAGAAGUTGGGGUGAAAGUURGAGG<br>UURGGGTGGGGAGGGRGAGUTGG |
| 23 | RGUAGGUUTRGRGUUUURGUTUURGUUUURGUUTGURGRGUUTUURGGGGRGUURGUA<br>TTAAAGRGUAUATGUAAGUUUATGAATTATUAAAUTGAAAGGAGUUAATTAURGGUTU<br>TAAAAAARGAGTGUTUTGRGUTRGUAGRGUUUURGGGUUAUTGXGUUTATTTARGGAGRG<br>ATUUTAUUUTRGUURGGUUGGGAGGGGGGUUTRGGGAGGGAGAGAGARGGAGAAARG<br>GAGUURGAGAUURGGGAGAGAGURGGAGAGGUAGGGAUTUGGAGAGUUTUGGGAUUARG<br>AAGGAGAGGRGGGGAGAGAAUURGA |
| 24 | TRGGTUTUTUUURGUUTUTUUTTRGTGUUTUUUAGAUUTUUAGTUUUUTGUUTUTURGG<br>UTUTUTUUURGGTUTRGGGUTURGTTUTURGTUTUTUTUUUTUURGAGGUUUUUTUU<br>UUAGURGGGRGGGGTAGATRGUTAURGTAAATAGGXGGATGGUURGGGGRGUTGRG<br>AGRGUAGAUAUUTRGTTTTTAGAGURGGTAATTGAUUTUTTTUAGTTGATAATTUATG<br>GUTTGUATATGRGUTTUAAUTGGGGRGUUUURGGGAGGRGRGGUAGGRGGGGRGGGA<br>GRGGGGRGRGGGUUTGRG |

| SEQ ID NO: | Sequence |
|---|---|
| 25 | AUAGTRGUTGUAGGGAGGARGRGGGURGTGAGAAUURGGGGAUAGUUUUUUUTUT<br>TGRGGTUUTGUAGTUURGGAUUUAUTGGGRGGAUAGAAAGTTTGUAGGGAGUUA<br>GGGAUUAGGAGAUAGAUAGAUAGRGUAGGGAUAGAGAAAGXGGAGGGATGUUAG<br>AAAGAURGAGTRGGGGAUAGAUAGAGAGAUUUAGGGTGAGAUAGAGGAAGAGAT<br>AUURGGGGUTGAAAARGGTGGUAGAAAGTGAGUAAUUAGGGAGAUAGAAAGAGR<br>GUAGAAUTRGAAAUUURGAGGUAGAGA |
| 26 | TUTUTGUUTRGGAAUUURGAGUUUGRGUUUUUUUGUUUUUUAAGUUGUUAUUU<br>UUGUUAURGUUUUAGUUURGGGUAUUUUUUUUUGUGUUAUUUUGGGUUUUUUG<br>TUUGUUUURGAUTRGGTUUUUUUGGUAUUUUUXGUUUUUUUGUUUUUGRGUUGU<br>UGUUUGUUUUAGUUUUUGGUUUUUGUAAAUUUUUGAUURGUUUAGUGGGUURG<br>GGAUUGUAGGAURGUAAGAGGGGAGGUUGUUURGGGUUUAGGGUURGRGUUU<br>UUUUUGUAGRGAUUUGT |
| 27 | TUAGUUUGUAUUURGGRGUUGGUUUUAGAUAGUUAGGUGUUGUUUGUAGGUUU<br>UGUUUGUAGGUGGGGUAUGAAGUAUUUUGGUAUUTTARGUUGGGAUUGGUUUUUUA<br>UUAGGGUUGGGGRGGGUUGUGGUUAUUUGGUURGGRGXGURGUAGGAGGUUGGUUUR<br>GGAGAAGAUUUGGGGGRGUAAGAUUUAGAGGUUAGAGGGUGUAGURGUUGUGAU<br>UUAUUUGGRGARGGGGRGGUUGGGAGGAGRGUUAGUUUUUGUUGUGAGRGAUUUGA<br>GAGUUAGGGUUAAAUTUGGGU |
| 28 | AUUUAGAUUUGGUUUUGGUUUUUAAAUUGUUAUAAUAGGGGUUAGRGUUUUUUUU<br>AGURGUUUURGUURGUAAAUTGAGUUAGUAGRGGUUGUAUUUUUUGGUUUUUUGAGUUUT<br>TGRGUUUUUAGGUUUUUUUURGGAGUUAGUUUUTGRGGXGRGURGGGUUAGGUGAU<br>UAUUAGUURGUUUUAAUUUUAGUGAGAGAUUAAUUUUAGRGUAAAUAUUAGGGUGU<br>UUAUGUUUUAGUUGUAAGUAAGAURGUGRGAGGUAGUAUUUGGUUGUUTGGAG<br>GUUAGRGURGGGGUAUAGGUUGA |
| 29 | GUUUAGUUUAUAAAGGTGAGUGGGGUAUUUUUAGUUGURGAGUUUUUUAGUUA<br>UAGUUUUAUAUUUAUAUUUUUUGUGGURGUAUUUAUAGUUURGUUUURGGUU<br>UAUAGGUAUUUUAAGAAGAAGUGUUGUUUUAUUAUAGXGAGAAGAGUAGUUU<br>UUGXGGUUUUUUUGGAGUAAUGUAUAGGGUUUUUURGGGGUUUUUURGUUAGUGA<br>GGGUAGURGGGGAGGUUUUUUUUURGUUUAURGUUUURGGUAGAGUUUUUAGGA<br>GUUAGUUGAARGGGGUUAUGUUUAURG |
| 30 | RGATGGGUAUGAUUURGUUUAGUUGUUUUGGAGGUUUUGURGGGGRGGUGGGRGG<br>GGAGGGGGUUUUUURGGUUGUUUUAUUAGRGGAGGAGUUUURGGGAAGAUUUUG<br>UGUAUUUGUUUAGGGGAGUXGUAGGAGGUUGUUUUUUXGUUUTGAUGGUGGGUAGA<br>UAUUTUUUUUAAGGAUGUUUGUGGGURGGGGRGGGGUUGUGAGGUGRGGUUAUAG<br>GAGAAUGUGAGGUUAUGAGGUUGUUGAUUAGGGGAGUURGGUAGUUGGGGGUUUU<br>UAUUUAUUUTUGUGAGGUUGGGU |
| 31 | TUAGAAUAAUGGUUGGUUUGUAGAGAUUAGAAAUGUUUAUUGUUGUUUUUUGUAU<br>UUUUUUAUUUAUUUAGAUUGAGUUUUUGAAGUUGUURGGGGGUUUGGAGAGAGAAG<br>UUAUUUAAGGAUAGUAGUUGUUGAUUUAGAXGUUUAAAUTUUTXGGGXGGAAAAGG<br>AUUUTAGAGAAUGUUUAAAAUTRGUGGUUUAAUUUUUTAUUUGGAAGUUGGGGUUURG<br>AAAAGURGGGGUUURGAAAAGUUGGGAGAGUAGUUUAAAGRGUAUUGUUUUAUUAA<br>AUGUGGAUGUAUGUUGGAURGU |
| 32 | GRGGUUUAGRGUUGUAUUUAUAUUUAGUGGGUUAGUARGUUUUGGGUUGUUUUUUUUAG<br>UUUUUUTRGGAGUUURGGGUUUUUTRGGAGUUUUUAGUUUUUAAUTGAGGGAUUGGGUUARG<br>AUUUUAGGUAUUUUUUAAGGUUUUUUUUXGUUXGAGAAUUUGAGXGUTUUTGAGUUAGU<br>AGUUGUUGUUGUUUUGAGUGGUUUUUUUUUUUUAGGUUUURGGAUAGUUUAGAGGUUUA<br>GUUTGGGUGGGUGGAGGGAUAUAGGAAAUAGUAGUGGGUAUUUTUGAUUUUUAUAA<br>AUUAGGUUAUUAUUUTGGA |
| 33 | AAGTTUTGGGGUAGAAGUUGGAUAAUUAGGGUUUGAGAAAUAAAGAUAAGAGGGU<br>AUAUUUUTUUUUUAGGAGAUAAAAGAGAAGGUGGAUGGAGAAGGGGAAAUTGGGU<br>UTUAGUUAGUAURGGGAUGAUGRGAUUAGUUUTGUAGUAXGUUUGGGGAGUAUAU<br>AUAURGUUUGUUUTGGUUGGAURGGAGAAUTGUGAUUAUUAUUUUUUAAUUUAUUUU<br>UUUUAAUUARGUAGGUUGGUAUGGUUARGUUUAUAGUGUUUUAAGUGUUGUUUGUUUU<br>UGUAGUTGAUTUAAUTUUTUTGTA |
| 34 | TAUAGAGGAAGUGAGUUAAUUTGUAAGGUAGGUAGUAUUUGGGGUAUUGUGGGRGUG<br>GUUAUGUUAGUUUUGRGUGUUUGGGGGAUUGGGUUGGAAGGGUGGUGAUAUAGUUUTUR<br>GGUUUAGUUAAGGGUAAGRGGUGUGUAUGUUUUUUAAGXGUTGUUGAUAAAGUUGGUR<br>GUAUAUUURGGUGUUUGGUUGAGGGUUUAGUUUUUUUUUUUUUUUAUUUUAUUUUUUTUT<br>TGUTUUUTGGGGGAGGAAUAUAUUUTUUUTAUUUUTAUUUUUTUTAGGUUUUTGGUUAUUU<br>AAUUUUTGUUUUUAGAAUUT |

| SEQ ID NO: | Sequence |
|---|---|
| 35 | TUAGAARGTGUUUAUAUATGUUUAUGUUUUTATUUTGUTGAAATUUAAUUUUUU<br>UUTUUAAAGGUUAUUGUAGGGAGUUUUUUAGGGUUUAAURGGAUUAGUGUUUAU<br>UUGUUUUGUUUUGUAUAAAGRGUUUUUUUUGUUUUUUUXGUGUGUAUUUAGAGAAUU<br>UUGAUUUUGAUUGAAUAUUUGUGUAUUUGUUUUUUUUUAGUUUAUUUUUAUAUGG<br>UGAGUUAUUGGUUUAUUAUUUUUGUAUGAGGUAAGGGUUURGUUUAUAUUAGG<br>UGUUAAUUAGUGUUAURGGU |
| 36 | URGTAAGUAUUGGUUGGUAUUUGGUGUGGGRGAGAUUUUUAUUUAUGUAGAAAUG<br>AGUAAGAAURGGUGAGUUAUUAUGUGGGGGUGAGGUUGAGAGAAAAAUAAGUAUAU<br>AGGUGAUUUAGUUAAAAUUAGAAUUUUUUAAGUAUAUAXGAAAAGGGUAAAAGGG<br>GRGUUUUGUAUAGGAUAGAAUUAGGUAGAUAUUGAAUURGGUUGGGUUUUGGGAAGG<br>UUUUUUGUAGUUGGUUUUUGAAGGGGGGGUUGGAUUUUAGUAGGGAUAGGGGUAUGG<br>GUAUGUGUGGGUARGUUUUGAA |
| 37 | UAUUTRGTGUUUUUAUUUGUAAGUAUUGUGAGGAGUAGUAGUAGGAAGAAAAGGA<br>GAUUGGGUGUURGGUGUAUGGUGGUGGUUGAAAUGGGUGGGGAGGGGGUAGAAUA<br>GAUUUAGGUAGGRGUUGGUUGUUUUGAGAGGUGGAGXGGGUAUAGGXGUUUAURGU<br>UUTAUAURGGUUUUUUUAUUUUURGUUURGUUUUUAGGUAUAGUURGGAGUAGG<br>UGAUAGGUGAUAAAAUUURGUUUUUUUUUUUUAUUUUUAUUUUUUUUUUUUUUU<br>UUAAUUAUUUUUGGGUAGGGUAUA |
| 38 | TGTAUUUUAUUUAGGAAUGGUUGGGGAGGAGGAGGAAGAGGGUAGGAGGUAGGGGA<br>GGGGGRGGGGUUUUUGUUAUUUGUUAUUUGUUURGGUUGUGUUUAGGGRGGGRGGGR<br>GGGGGAGUGGGGGGAURGGUUAUAAAGRGGUAGGXGUUUGUGUUXGUUUUAUUUUUU<br>AAGUAGUUUAGRGUUUGUUUGAAUUGUUUUGUUUUUUUUUUAUUUAUUUUAUUAUU<br>AUUUAUGAUAURGGGGUAUUUAGUUUUUUUUUUUUUUGUGUGUGUAUUUAUAGUUGU<br>UUAUAGGUGAGGGGGUUARGAGGUG |
| 39 | AGARGGAGAAAUAGAAARGGAGGUUAGGRGGGGGAGUUUUGGGGAUAGGUUUGGGA<br>UUGAGGUGRGGAAAUGGUUAGAGGAGRGAAGUUUUGGRGGGAUGUAGUGAUUGGAGU<br>UAAAAGGAAAURGUUURGGUUUGUUUAARGRGGGGGGGGUUUXGGUURGGUGUUUUU<br>GAGRGAAURGAUUGAURGUGGUUUURGURGUAUUUUAUUUUUUAUUUUUUUUAGAUU<br>UUUUUUUUAGUUUUUUUGAGGRGGAAAGAAAAAUUUUAUAUUGGUUUUAGUU<br>UUGGGUUUUUGUUUUGGUUUUUUUT |
| 40 | AGGAGGGGUUAGGGUAGGGAUUUAGGGUUGGGAUUUAGAUGUAGGGUUUUUUUUUR<br>GUUUUAGAAGGAGUUGGGAGGGAGAGUUUGGGGAGGGUGGGGGAUGGGAUGRGGR<br>GGGGGUUUARGUGUAUUGGUUGGUUAGGGUUAAURGGGUXGAAGGUUUUUUURGRGUU<br>GGAUAGGUGRGGGAURGGUUUUUUUGGUUUUAAAUUAUUGUAUUURGUUUAGGGUUURGUU<br>UUUUUUGRGGUUUURGGGUUUAGGGGUUUGGUUUGUUUURGAGGUUUUURGUUUGAU<br>UUURGUUUUUGUUUUUURGUUT |
| 41 | TUAAAUUUUAGGUAUUUGGGUUAGUAGGUGUUUUUUGUUAAAGAGUAUUUGUGG<br>UUAAAUUUAUUGGAUGUGAUUAGUUUUUAUUUUUAUUUURGUAUAUUUUUAGUUUUUGUUUUAU<br>UUUAAAAAURGGAUUAUUUUUUUUUGUUUAGAAUUXGUUUUGUUUUUGGUGAUAGUGGU<br>AUAUAUUUUAUAUUUGUUUUUUUUGUUUAGAGUUUUUUUUUUUUAUGUUUUUAUU<br>UUUUUUAUUGGGAURGGUUUGGGUGUGUGUGUUUAAUUGGAUAUUAUUUUGUUGGGUU<br>UUUUUUUUUAUUUU |
| 42 | GAGTGAAGGAGAGGGUUUUAAUAAAUAGUGUURGAUUGGAAUAGUAUAUUUAGGGUR<br>GGUUUUUAGUAGAGGAGGUGGAAUAUGAGAAGGAAGGAUUUUUGGGUAAGGGAAGAG<br>GUAGUAUGAGAGUAUGUAUUAUUGUUAUUAAGAGUAGAAXGAGUUUAAGUAGAA<br>GAGAGUUGAUURGGUUUGGAUAAGGUAAAGUUAAGAGAUGAGGAAAGAUAAAAUUG<br>AGUAUAUUUAGUGAAUUUAGUUUAUAAAGUAUUUUUUGGUAGAAGAAUAURGAUUA<br>GAUUUAGAAUAUUUGGGUUUGAU |
| 43 | AAGTGUUUUAUUUUUGAGUGRGAUUUAAGUUAGGAGGUAGGAGGUGAUUGAGG<br>GAUARGGAGGAGGUAUGUAUUAUUUAUAGUAUUGAGGGUAGAGUGUGUGUAUAUAUU<br>AAGUAAGGAAAUGGGGURGGAAAUAUGGGGUAAAGGGUUUAXGGAUUGAAUGGUGGA<br>UUUUGGAUGUGGGUUAAUUUUUUUUAGUUUUUUGAAAGAGGAUUAGGUAAUGUGGUUAU<br>GAAUGGGUUUUAAUGAGAAUUGAUUGAUUUGRGURGAGAUGUUUUUUUUUUUUUUTAAA<br>AUAGAAAAUGAUAUAUUUUUA |
| 44 | TGGGGGTAUGUUAUUUUUAUUUUAGGAAGAAAAAGAAAAAUAUUUURGAGRGAAUUAAU<br>UAAUUUUUAUUAGGUUUAUUUAUAGUUUAUUGUUUGGUUUUUUUUUAGGGGGUGG<br>AAGAAGUGGUUUUAUAUUUUAAAUUUUAUUAAAAUUUAAUUXGUAGGGUUUUUGUUUUUAUAUU<br>URGGUUUUAUUUUUUUGUUUGAUGUGUAUAUAGUUUGUUUUUAUGUUUGUGAGUGUUU<br>GUAUAUUUUUUURGUGUUUUUUAGUUAGUUUUGUUUUUGAUUGGGUARGUAUUUU<br>UAGGAGGUAAAGAUAAUU |
| 45 | GGATGUGUUAGGUUUUAGGGUUUAUAUUUUUGUAUGUAUUUAUAGUAUAGUUUAUUUU<br>UGGAAGGUUGUAGUAGAGUUUUGGGGGGUAUAGUUGUUGUGUUURGUAGUAGUUUGGAAGUUU<br>UUUGAUUUUAUUUUUUURGGUUUUAUUAGUAGUUURGUUXGUUUUUUAUAUUURGGA<br>UUAGUARGUAGUUUUGUAUGUUUUUUUUUUUAUAUAGUAGGUUAUUUAGUUGUUUGUGGUGG |

| SEQ ID NO: | Sequence |
|---|---|
| | ATGUUAUURGTGAAGRGUTAGUATGGGGAGAGGAUAGUGRGUGGGUGGGUGG<br>GGUAGGAUUUUUUUGGUUUU |
| 46 | GAGAUUAGAGAGAUUUGUUUUAUUUAUUUAUUUARGUAUUGUUUUUUUUUAUG<br>UUAGRGUUUUARGGAUGGUAUUAUUAAUAAGUUGGUUUUGUUAUGUGAGGAGG<br>AUAUGUAGGAUUGRGUGUUGGUURGGGUGUAUGGGGAGXGGARGGAGUUGUUGGUG<br>GAURGGGAGAAUGAGGGUUAGAAAUUUUUAGUUGUUGRGAGUAUAUAGUUGUUUU<br>UUAAAUUUAUUGUAUUUUUUAGAAUGGGUUGUGUAUGAGUAUAUGUAGGGUGUG<br>GUUUUGGAGUUUGAGUAUAUUU |
| 47 | AGUUAGGAAGGGUUGUAUUUUUUUAGUGGUUAGRGUAGGUUGGRGUUUUGGUUGUU<br>GGRGUAAGUUUUAAGUUGUUUUUUUUUUUUUAGUAAGUAUGGGRGGUGUGGGUAUG<br>RGGGGUGUUGGGUAUUGAUUUAUUURGGAGAUUAUXGGUUUUUAUAUAUUAUU<br>UUUGAAUGAUUUGAAUAUUUUAUGAGGGUUGAAUGUUUUGUUUUUAGGGAGUUUA<br>GUUGGAGUUGGAGUUAGUAUAUGGAGGGUGGAGAGAGUUUUXGUAGUUAUURGGGU<br>UUUGUAUAGUUUGUAGGUAGAAU |
| 48 | GUUUUGUUUGUAGGUUGUAUAGGGUUURGGGUGAUUGXGGGAGUUUUUUUUUAUUUUU<br>AUAUGUUGGUUUUAGUUUUAGUUGGAGUUUUUUGGAGGAUAGGGUUAUUUAGUUUUA<br>UAAAUGAUUUAGAUUAUUUAGAGGUUGGUUGUGUGGGAGUXGAGUUGGUUUURGGAGGU<br>GAGUUAGUUAUUUUAGUAUUURGUAUAUUUAUAURGUUUUAUGUUUGUUAGAAGGGGA<br>GGGGUUAGUUUGAGAUUUGRGUUUAGUUAGGARGUUUAGUUUGRGUUGAUUAUUG<br>GGGAAGUUGUUAGUUUUUUUUGGUU |
| 49 | GGGUGUUGGGUAUUGAUUUAUUURGGAGAUUAUXGGUUUUUUAUAUAUUUAUUUU<br>UGAAUGAUUUGAAUAUUUUAUGAGGGUUGAAUGUUUUGUUUUUAGGGAGUUUUAGU<br>UGGAGUUGGAGUUAGUAUAUGGAGGGUGGAGAGAGUUUUXGUAGUUAUURGGGUUU<br>UGUAUAGUUUGUAGGUAGAAUUUAUAAAUUGGAUUUUAAAGUUAUUUUUUUUAAG<br>GUUUGGAGAUUUUGUGAGUUUUAUUUUI1UGGUUUUUUUUAGAGUAUAUGGAAUUUUAUA<br>UAAAGUUGAGGAAUUUUUUGU |
| 50 | AUAAAGGGUUUUUUAGUUUUAUGUAGAGUUUUAGAUGUUUUGAGAGUUUAAGAGUUG<br>AAAUUUAGUAGAAUUUUUAGGGUUUUGAGAGGAGUUGGUUUUAGGAGUUUUAGUUUAU<br>GGUUUUUGUUUGUAGGUUGUAUAGGGUUURGGGUGAUUGXGGGAGUUUUUUUUUUAUUUU<br>UAUAUGUUGGUUUUAGUUUUAGUUGGAGUUUUUUGGAGGAUAGGGUUAUUUAGUUUUUU<br>AUAAAUGAUUUAGAUUAUUUAGAGGUGGUUGUGUGGGAGUXGAGUGGUUUURGGAGG<br>UGAGUUAGUAUUUAGUAUUUUU |
| 51 | AGUUUAUGAAGGUAUUUUUUUAAAGUUAGGUGGUUAUUAAAAAAUAGGUAAUUAAU<br>UUUGUUAUUAGURGRGGGGAUAGRGAGGGUUUUGGGGUUUUGGAGGGGGAGGAUGURG<br>ARGAUGURGAURGRGUUAUUAGAUUURGURGGGAGGAGGGXGRGGGRGUUUUUAUUUG<br>UUGUAAAGAARGURGGGUUUUUUUGGGUUAUUGGGUGURGUUURGGRGGGGAGRG<br>RGGAAGGUUGGGGUUUUAGGUAGUUUUAAUUAUUUAUUUGUUGGUUARGGGUURGRGG<br>RGURGGGGGAUUUUUAUUURGGA |
| 52 | UURGGAGUAGGGUUUURGGRGURGRGAUURGUUAAUUAGUUAGGUGAAUGAUUGAAGU<br>UAUUUGAGGUUUAGUUUUURGRGUUUUUURGURGGAGRGGUAGUUUUAAUGUUUAG<br>AGGAAUURGGRGUUUUUUUGUAAUAAGUUGGAGRGUURGXGUUUUUUUUUURGGRGAGA<br>UUUGAUGRGRGGUUGGGUAURGUUGGGUAUUUUUUUUUUUUAAGUUUUAAGGUUURGUU<br>GUUUURGRGGUUGGUGAUAGGAUUGAUUAUUUGUUUUUUUUGGUGAUUAUUUAAUUUUG<br>AAAAAGUGUUUUUAUGGAUU |
| 53 | GUUUGUAGUUGGGAAUGAAUGGAAUGAAGGUUAAGGAUGAAGUUAAUAAUUAAAUAU<br>UGGGUUUUUGGGUGUUUGGUAAUUGUURGGUUUUUAGUUUAGGGUUUUUGGGUGAUAU<br>UUUUUUUUUGUGGGGAAGAUAGAGUUAAAUGAGAAAXGUUGAGUUUGAGUUUUAGGGGGA<br>AAGGAUAUAUURGGAGAUGUUUGAGGGGGUUUAGGGGUAURGUAAUUUUUUUGUUAG<br>UUGGUAGAGUUGGGGGUUGAUARGGUUUAGUUGUUGUUUUUGGAGUUUURGGUUUUUUUGU<br>UUUUUUUUUGAGGAUUUUGAG |
| 54 | UUAAAGUUUUUAGGGGGAAAUAGGAAGGURGAGGAUUUUAGAGAGUUAGUUGGURG<br>UGUUAGUUUUAUUUUGUUAGUUGAGUUAAGAGAUUUUARGAUGUUUUGGAGUUUUUUA<br>GGUAUUUUURGGAUGAUUUUUUUUUUUGGGUUUUAAUUUAXGUUUUUUUAUUUUGAUUUUU<br>GUUUUUUUUUAGAAGGAAGAUGUUAUUUAGGAAUUUUUAAUUGGAAAAURGGAUAGU<br>UAUUUAGGGUAUUUUAAAAUUUAAUAUUUGGUUAUUAUUUUAUUUUUUGAUUUUAUUUUU<br>AUUUUAUUUUUUAGUUGUAGAUA |
| 55 | UUAGUUGUAGAAUAGGUAUUGUUUUAUUAUAUAGGUUAGAAGAGGUGUUUUUUUUUAU<br>AUUGGUUAUUGAAAUUAUUUAUUGGUUAGUUAGUGGGUGUUUAUUUGGAAAAUUAAGAU<br>GGUUUUUUUUGUUAGAGUUAGGUUAUUUUGURGGAGGUUGUUUXGAUURGUUGUGAAGU<br>AGGGUUGGAGGUUAUAUUUAUAGGUAUUUUUAGUUUUUUUAAAUAAUAUUGUUAGUUGUA<br>GAUUUUGUUGGUUUUUUUAGAGAAGGGGAAAARGGAAAUUUAUAGAAGUAAUUAGAG<br>GAGUGAGUUAGAAGUUUUAGGUAUG |
| 56 | UAUAUUUUGGGUUUUUAUUUAUUUUUUUUAGUUGUUUUUUGUGAGUUUURGUUUUU<br>UUUUGAAAGAAUUAAUUAAGAUUUAUAUUAUAGUUGUUUUUGAAGGAUUAGAGAGUG |

-continued

| SEQ ID NO: | Sequence |
|---|---|
|  | UUTGTAGTGTGUUTUUAAUUUTGUTTUAUARGUATXGGGAUAUUTURGGUAGGGTG GUUTGmWGUAGGGAGGGUUAUTTTGTTTTUUAAGTGGUAUUUAUTGUTGUUAGT GAGTAGTTTUAGTGGUUAGTGTGGAGAGGGUAUUTUTTUGGUUTGTATGGTGGGU AGTGUUTGTTUTGUAUTGG |
| 57 | TURGGUAUAATTUTTAATGAGTUUURGAGUUUURGUAGTUUGTUTAUTTUTTTTU TTTTUUAGTGAAUUUTAUAGTUUUUTTUUUUTGUAUGTUTUTUTGUUUUAAATTTUT GAAGUUUUTUUUTTURGTUTUUTTAAGAAUTUTAXGAAUURGAAAGUURGTGAGG UTGAUGGUARGTUTGTGGTUUUTTUTUUTTUTUUUUTUUAUAUUUAUAGUUUUURG GGAURGGAUUUTUUUAUUAUUAGGTGUAGGGUUAGGGGUAGUAGUAGGAGGA AUAGUUAUAGGUAGAGGUG |
| 58 | UAUUTUTAUUTGUGGUTGUUUUTUUTGUTGUTGUUUUTGGUUUGUAUUTGGUGAG TGGGGAGGGUURGGUUURGGGGAGUTGUGGGUATGGAGGGAAGAAGGAGAAAGGA AUUAUAGARGTGUUAUAGUUUARGGGGUTTTRGGGTTXGTAGAGAUUTTAAGAG ARGGAAAGGGAGGGGUUUAGAAAUUUGGGAUAGAGAAUATGUAGGGAAAGGGGA UTGTGAGGAUUUAUTGGAAAAGAAAAGAAGTAGAUAGGGAUTGRGGGGGGUTRGGGG AUUAUTAAGAAUUGAUGURGGA |
| 59 | AGUUTGTGUTUAGGAAUAAUUAAGGAGTGGAGUGUAUAAUUUUUUUUUAAAUU RGGARGTUUTUUUTURGAUUUAAGUUUUAGUUUGAGGGUUAUUTUUUTTGAUUAUUU TTGGAAAUAGAUAUUAGUUAAGGGAGUGUTUTUGGXGUUGARGAGGAUURGATT TAGGUUAGUAUUTUAGUUUUUAUUUUAUAGAGGAAUUGAUUGGAGGUUAGUGTG GURGAUGAGUUAUURGGAAUAUAAGUAGGUAGUUATUUUGAAUUAAAUGGUAUUU GAUUUUUTUUTUAUUUGA |
| 60 | TUAAGGUGAGGAGGGAGAUUAGAUGUUAUUUAGUUGGAAAUAGUUGUUUGUUUGU GUUURGGAUGAUUUAURGAUUAUAGUUGUUUUUAGUUAGAUUUUUUUGUGGAGUG GGAAUUAGAAUAUGUGAUUUAAATRGGAUUUUGUUAAXGUUAGGAGAUAGUUUUUT TGGUUGGUGTUUTGTTUUUAAGGGGUGAAUUAAGGAGAAUGGUUUUUAGGUGGGUU GAGTRGGAGGAAGARGTURGGAUTGGGAAGGAGGUUGAUGRGGUUUUAUUUUTA GUTAUUTUGAGUAUAGGUU |
| 61 | GAUUUAGGAUUGUGAAUGGUUUUUGGAGUUUUUUGUAGAUGAGGUAAUGUTUUGGUUU AAUUUAUAGGUUAGAUUUGUGUGUUUAGUAUUGGUURGGGAGGUUUUUAARGG AAGGUUGTGUUAGUAUAAAUUAUAUUUUGAUGAXGAGUAGAGAUITITGAUTG GUUUUAAGAARGRGTTUUUUAAUUUAUUUGGGAUTUUUUUGAAUUAGURGGUUAU AUAUAUUAGGGUUUUAGAGGAUUUUUUUGUUUUUUTUUTUTUGTUTUTUUTGGG TTTUUTAUUAAUTAATT |
| 62 | ATTAGTAAUAGGAAAAAUUUAGAAAGAGAUAGAGAGAAAGGGGGGAAAAAAAUUUT UUGAGAAUUUGGUAUAUGUGGURGGUUAAUUUAAAAAAGUUUUAGGGUAAGUUGG AAAARGRGTTUTTTAAGAUUUAGAUUAAGGUTUTUGUTXGUUAUAGGAAAUAUGAT TTGUGUUAAUAUAGGGUUUURGUUAAAAAUUUUURGGGUAAGUUAGUUAAGGAUAG UAGGTUUGAUUUAUGAGTUAAUUAAAAUUAUUUUAUAUUGUAAAGAAUUUUAAGA AUUAUUUAGAUUUGAGGUUU |
| 63 | GUUUGGAAUUUURGGRGAUUUUUUGUUUUUUAUUAAGGGAAUUUGUGUUGUAAUAU TTUAAGUUUAGUUGAAAAGUGGUUUUUUUGGGUGAAGUUUUAUUUGUGUAUUUAUU TGAGGGUGAGUUAGUUUTGUUUUUUTGGUUUUUAURGXGGUUGUUAUAGUAUTUAU RGGAGUUUUAUAGTGAUUAUTUTGUUAUUAUUUUUURGAUAAAUUUUUAGUUUU TGAAGGGUUAGAGAUAGUAUAUAAUUAUUUUUUAUAAUUUUURGUGUUAGUGUUAU TUUUAAUUUUUAGUAAGUAT |
| 64 | ATGUUUAUUAGGGAUUGGGAGUAGUAUUAGGUARGGGAGUUAUAAAAGAUGAUUAT GAUGUGTUTUTGUUUUUAGAAGUUGGAAGGTUUGUTGRGGAGGGGUGAUGGAUAAA UGAGUUAUUGTGGGAUUURGGUAAATGUUAUAAUAGUXGRGGUGAGAGUUAGGGGA GUAGAGUTGAUUUAUUUTTAGGTGGGUGUAUAGGUGAGAUUUAUUUAGGAGAUU AUTTTUAGUTGAGGUUUAAAGUGUUAUAAGUAGAGUUUUUUTTGGUGGAGAAAAUUAA GAGAUGRGURGGGGUUUUAGGU |
| 65 | AAUUUUUUUUUURGGGAUAGUAARGAGGUUUUAAUUUAAAAUUUGUAUUGAAGUUTT GUAGAGAUUUAUAAUUGAUUUAUUUAGGUUUUAAUAUAUAGUAGUGUUTUTUUAUGG TTGRGUUAGGUAGUGAAGGAUAUAGGGUUAGUAGGAAAXGAGUUURGGUUUTUAGGT GGAUUURGTGUUTUUAUUUUTGUUAGAGUUUAGGUUUTGAGGGUUATAGGGUUAAAT TGUUAUAGAGUUUAGAGAAAUUGUGUUTUTUURGTUUUUUAUUUUAAGAUUGAGUU GUTGGAGGAAAGAGGUUAGG |
| 66 | UUTGGUUTUTTUUUTUUAGUAGUUUAGUUUUAGGGUGGGGGARGGGAGAGAUAGAT TTUTUTGGAGUUUTGTGGUAAUUTGGUUUUTAUGUUUUAGGGUUTGGGUUTAAUUA GAGGUGGAAGUARGGGAUUUAAUUUGAGAAUURGGGAUXGTTUUUTGUGUGUUUTGUA TUUUUAUTAUUTGGRGUAAUUATTGGAGAUAGUGUGUGUGUUAGGGGUUUGGGUA AGUUAGUGUGAGUUTUTGUAAGUUUUAAAUGUAAGUUUAAAUUGAAAGUUTRGTTGA UUAUUURGGGGAAGGGAUUT |

| SEQ ID NO: | Sequence |
|---|---|
| 67 | AGGAATGTTTAUTGAAGGAGTGAATGAAAUTATTGUATTAGAUAAGUUUAGGTGU<br>AGAGGAUTGGTTTUAUAUAGAAAGUATRGATTTTGUUUUTAUAGAAUUUTGAUUUA<br>GTTTTUUAGUAGAUAAUUUUTGGUTGUGAAGAUAGAGGGGXGGGGAGGAAGGUAGGG<br>GUTGAUAUUTUUUUAGUUUUUUUUAGGURGGUGGGGAGUGAAUAGUUAGUGAUU<br>GUUUAGGAGUURGAGGUAAAUUAUAGAUUAAGAGUUAAGAGUAUGAUUAUAU<br>TTGUAUUTUUTUUAGUUAUGAUA |
| 68 | TGTUAUGGUUGGAGAAAUGUAAGUAGUGAAUAUGAUUUUUGGUUUUUAGUUUGUGG<br>TTUAUUTRGGGUTUUTGGAUAAGUUAUUGAGUUAUUUAGUUUUUUAURGGGUUGG<br>AGGGGGUUGGGAAAUGUUAGUUUUUAUUTUUUUUUXGUUUUUUTUGUGUUUUAUAUUA<br>GGGUUGUUTGUUGAAAAUUGGAGUUAGGGUUUUGUAGGGUAAAAURGAUUGUUUUT<br>AUGUGAAAUAGUUUUUUUGUAUUGGGUUUGAUUAAUGUAAUAGUUUAUUAUU<br>UTUAGUAAAUAUUUT |
| 69 | GUUGGGAUUAUAUAUGUAUAUUAUAUGUURGGUTAAUUUUTAUAUUUUUGGUAGAG<br>AUAGGGGUUUAUUAUGUUGGUUAGGGUUGGUUUUGAAUUUUUGAUUUAGGUGAU<br>UAUUUAUUTUGGUUUUUUAGAGUGUUGGGAUUAUAGGXGUUAGUUAUUGUAUURG<br>GUAUAAGUUAUUUUAAAAUAGUUUUUUUUUUUUUUGAAAUAGUUUUUUUGUA<br>GUUUAGGUGGAGUGUAGUGGUAUAAUUUAGUUAUGUAAAUUUUAUUUURGG<br>GTTUAAGTGAUUUTTGUGU |
| 70 | GUAUAAGAAUUAUUUGAAUURGGAAGGUGGAGGUUGUAGUGAGUGAGAUUGUAUU<br>AUUAUAUUUAGUUUGGGUAUAGGGUAAGGUUGUUUAAAAAAAAAAAAAAAGU<br>TGUUUUAAAAUGGUUUUGUGURGGGUGUAGUGGUUAXGUUUGUAAUUUUAGUAUU<br>UGGGGAGGUUAAGGUGGGUGGGAUAUUUGAGGUUAGGGGUUAAGAUUAUUUGGU<br>UAAUAUGGUUGGAAUUUUTAUUTAUUAAAAAAUAUAAAAAUUAGURGGGUAUGGUG<br>GUGUGUAUAUAAUUUUUAGU |
| 71 | AAUAAAUGUUAUAGGUUUUAAUUGUAGGUUUAAGGGAGUUGAGAUUUUAUAUUGGG<br>GUUGUUGGAGGUAGAAGUUUUUUUAUUTUAGGAUUURGGAUUUGUUUUUUUUUUAR<br>GRGGUUURGUUUAGUUAGUUAUAUUUUUGGUUAUAGAGXGUUAUAAAGGUUAGT<br>GTGUGUAUGURGGGUUGAUUUAUAGUUGGUUUGGGUUUAGGRGAGGAUUUTUUAG<br>AGGGGRGGAAGGGGUUUUTUUUUTUUUGGUUAUUUUUUAUGGGGAGUAGUAAGUAA<br>UUAGGAUUAUGUUAGAUUUA |
| 72 | TGAAGUUUGGUAUGGUUUUGGUUAUUGAUUGUUUUUUAUGGAAAAUGGUUAGGAGG<br>GAGAGGGUUUUUURGUUUUUUUGAGAAGGUUUTRGUUUGGGUUUAGAAUUUAUG<br>TGAGUUAGUURGGUAUAUAUAUAUUGAGUUUUGUGAGXGUUUUGUGGUUAGGGUG<br>TAGUUGGUGGGRGGGAURGRGUGGGGGAAGGGGUAGGUURGGGUUUUGAAAGUGG<br>GAAGGUUUTGUUUUUAGUAAUUUUUAGUAUGGAAUUUAAUUUUUTGGAGUUUGUA<br>AUUAGGGUUGUGGUAUUTGUU |
| 73 | GUAGUUGUAUAAUAUAAUGUUAAGGURGUGGGGUAGUGAUGGUUUGGGUUUUUA<br>AUUUUUAGUUAGGUUGUUUUGUAGGUUUAUAUUUGUUUAUUGGUUAAAAUUUUAA<br>AAUAAUUTUGAUUGGGUUAUUUUUAUGUUAAAGAXGUUAGGGGUUGUUUUUAAAU<br>UTUTTUAUUUTGUUAGAAAGUUUUUUAUAGUARGGUUUUAAUUUAGUUUUARGUUUT<br>GAUUUUUUAUURGUAUUUUGUUAUAAAUUGUUAUUAGUGAAUUUUUGUGUURGG<br>UTUUAUAUUTUTUAUGUG |
| 74 | AGUAUGAGAAGUGUGGAGURGGAGUAGUAGGGGUUAUUAGUGGUAGGUUUAUGAG<br>UAGGAUGRGAUGGAAGAUUAGGRGUGAAAGUUAAGUGGAGGURGUAUUAUAGAAG<br>AUTTUTTGGUAGGGUAAAGAGAUUUGGGAGAGUUUUGAXGUUUUUGAGUAUAAGA<br>GUAGUURGAGUUAAAGUUAUUTAAAGGUUUGGUUAGUGGGUAAGAUGUGGGUUTGU<br>AGAAGUAUUTGGUUGGGAAGUUGGGAGUUUAAAUUAUAGUUGUUUUUARGGGUUT<br>GGUAUTGAUGUUGTAGUAUUGUU |
| 75 | AGGAGGGARGUGGAAGUAGUGGGUGGUAGAGAAAAGUGUGUAURGUUGGGAGGUU<br>TAUUTUAAGAAUAGGUUGGGAUGAGAAAAUAUGUUTGGGRGAGGGGGGUUGGAGGUU<br>RGGUGUUAUUUUGUGGAUGGAUUAUAGUUUUUGUAAUUGXGUGUUUUGUAAAGUUUGUU<br>RGGUUURGUAUUAUUTUUGAAGGUUUUTGGRGAUGUUUTRGAUUUUTRGUUUAAAGA<br>AGUGAGUUTUUAUAAGGUUUAGAGGUGRGGGAGUUAAAGRGGGAGUGAAGAUUUTR<br>GAGGGGUUUAAAUTGAAGUAGA |
| 76 | TUTGUUUAUUTGGAUUUUUTRGAGAGUUUUUAUUUURGUUUTGGUUUURGGUUUGTG<br>AAUUUUTAUGAGAGUUAUUUUUTUGAGGRGAAAAGUGAGGGUAUUGUUAAGAAUUUT<br>TTUAAAAUTGAAUGRGGGGURGGGUAAAAUUTUGAAAUAUXGUAAUUUGUAGGUGUGUGGA<br>TUUAUUUAUAGGUUGAUAURGGGUUUUUUAUUUUUTRGUUUAGAUAUGUUTUUAUT<br>UUUAAAUTAUUUATUUUTGAAAAUAGAUUUUUUUAGRGGUUGUAUAUUUUTUTUGUUAUUUA<br>RGAUUUUUAARGUUUUUTUUT |
| 77 | UUTUUUUTGAUUUGGRGAGUUUUUTUUUUUTUUUAUUUUUAUUUUAUUGUUUUUAUUGUUUUT<br>UUUUTURGGUUUTUUUTUUUUTUUUUTAGGUUUUUUUTUUTAGUUUAGUUUGGAGUUUAUA<br>TUUUUUUAUUUUTUUAUUTUUUTUUUUTUUUTXGUUUUAGGAUUAUUUUUTGGGAUU<br>UAUUUTGAGUUGAGUUUAUAGUUAGUUAGUUARGAAAUAGAGGUGRGRGGGGGUA |

| SEQ ID NO: | Sequence |
|---|---|
| | GGGTGGTATGGAGATTUTGXGGUUTTTGATTTGAUAUUTUURGGAGUTAURGUUAU AGGUUTGUUUATTTUAU |
| 78 | TGAAATGGGUAGGUUTGTGGRGGTAGUTURGGGAGGTGTUAAAUAAAGGUXGUA GAAUTUUUAUAUUAUUUTGUUURGRGUAUUUTATTTRGTGGUTGGUTGGUTGTA GGUUAGUUAGGAUGGGUUUAGGGAUAAUUUTGGGGXGGAGGAAGGAGGAGGU GAAAAGGGUGGAAAGGAUGUGAGUUUAAAUUGAGUUAGAGAAAAGAUUAGGAG GGGAGAAGAGGURGGAGGGAAAUAAUAAAAAGUAAUAAAAUGAAAUGGAAAGGAA AGGGAUUUAGGUAAAAAGGU |
| 79 | GUUAGUUUGGAGUUAUAUUUUUUAUUUUUUAUUUUUUUUUUUXGUUUU AGGAUUAUUUUTGGGAUUUAUUUTGAGUGAGUUAUAGUUAGUUAGUUARGAAA TAGAGGUGRGRGGGGGUAGGGUGGUAUGGAGAUUUTGXGGUUTTTGATTTGAUAUU TUURGGAGUUAUXGUUAUAGGUUTGUUUAUUUAUUUTGURGGGAAGAUAAUUTTUGG UUUTGGUGGUGGGUGGGTGAUUUUUAAAAUUAAGUAUGGUUUUUUTGG GUUAUUUUUAUGAUGUT |
| 80 | AGUAGUUAUAGGAAGUAAUUUAGAAAAAAUUAAUGUUUGGAUUUUGAGAGUUAAU UAUUUAUUUAUUAUUAGAAGUUAAAGUUAUUUUURGGUAGGUGAAAUGGGUAGU UUGUGGXGGUAGUUAURGGGAGGTGUAAAUAAAGGUXGUAGAAUUUUAUAUU AUUUTGUUUURGRGUAUUUUATTRGTGGUTGGUTGGUGTAGGUUAGUUUAGG AUGGGUUUUAGGGAUAAUUUTGGGGXGGAGGAAGGAGGAGGUGAAAAGGGUGGAA AGGAUGUGAGUUUAAAUUGAGU |
| 81 | UAUUUUAAUUTUTGUAAUUAUGUAUAGUGAURGAUAUUUAUAAUUAUUUUUUUT UAUUUAUGGUAAUGGGUUUUURGARGAGUUAGGAUUGAAGAAGGAARGAGGAAUAA AUTUUGGAGUGGAAGRGRGUUUTRGGUAGAUAGGAUURGXGGGGRGUUGGGGUAGUU AGGGAGAAGUUURGGUAUURGUUUUGTGAGGUURGGGGGUGUGGUUUUURGAGUUURGUU URGUUUURGGRGGGUUUURGUUUUAUGUUURGUUUURGUUAUURGUUUURGRGUUUUUUT URGUURGUURGURGAGUUGUA |
| 82 | TGUAGUURGGRGGGRGGGRGGAGAAGAGRGRGGGGGRGAUAGRGGGGRGGGGUAUG GGAGRGGGGUUURGURGAGGRGGGGRGGGAUURGAGAUUAUAGUUURGGAUUTUAU AAGRGGAUGURGGGGGUUUUUUTGGUTGUUUUAGRGUUXGRGGAUTUTGUUTGURGA GGRGRGUUUUAUAUUUUUUAGAGUUUUAUUTUTGRGTUUUUUUUUUAGUUUUTGUUUURGTRGG AGGAUURGGUUGUUUAUGGUGAAGGAAAAAGGUAAUUAUAAAAUATRGAUAAUAUGUGU ATGGUUGUAGAAGUUGGAATG |
| 83 | TATGAUGUUAGUGGUUGAAUAUUUUAGUAGAGAAAAAUUTUGAAUAAUUAAUKUUA GGUUUAGGAGAUAGUUGGGUAUUUGAGAGUUUAUGAGUUAUAUAAGUAAUUUUGGA GUUAAGUUGUAUUUUUUTGUUUTGGUUUUAGAGUUUAGUUTXGAGUUAUAUGUAGUUAGA UTGURGGUAGAGAAGAUGUGGAGUUGGUAUUUTGGUUUAGGUUUGAGUUAAGGUTRGT GGAAGUUUUUAGGUUUTUUGAUUUAUGGUURGUAUAGAGUUAUGUUUAGUUUUTGGGT UUAGUAGGUUAGUUAGGUGAG |
| 84 | UUUAUUUTGGUUGUUTGUTGAGAUUUAGGGUUGGAGUUAUGGUUUUTGTGRGGGUUAUG GUUAGGAAUUGGGGUUUUUARGAUUUTGUUUAGGUUUAAGUUAAGAAUGUUAGUT UUUAUAUUUTUTUTGURGGUAGTUTUGGUGAUUAUGUTGUTXGAGAUUGGUUUTGAGGUU AAAUAGAGAAUAUAAUUTGGUUUAAGGUUGUUUAUGUUGAUUUAUAGGUUUUUAAA TAUUUAGUUGUUUTUUUTGAAUUUTURGGUUGAUUAUUUAAGAUUUUUUTUUTAUUTAAGGT AUUUAAUUUAUUGGUAUUAUA |
| 85 | GGGGUUURGUAGUGGUUUAGUUTUGUUTUGGGUUUUUGUGGAUGUUUUUURGAGAAUUA URGRGUAAAUUUUUUUUAGAGGUUUAAUAUUUUAARGTGUTGAUUUUURGGGUUUGTG TUTUUUUTGURGUAGAUTGAAGXGTTUUURGGUTGAAGGTGAGGTTUTGUAUUUAAXG AGTRGUAGAAGUUURGGGUAGAGUTGGUGGGGUAGUUUAGAGGUTGGGAUUUGAU AUUTUTGAGUAGGAGGUGAURGUUURGGUAUUAGUTGUUTGUUAGAUUUUTGAAGG AGUAAGGUUUGRGAUUAUAUU |
| 86 | GGTATGGUURGUAGGUUUTGUUTUUTUAGGAUUTGGUAGUUAGUUUUUUKUUUUKU GUUAUUUUTGUUTAGAGAUGUUUAAAUUUUAGUUUUTGAAGUUGUUUUAUUAGUUU TGUURGGGAUUUTGRGAUUXGUUGGUUGUAGAAUUUUAUUUUAGURGGGAAXGUT TUAGUUTGRGGUAGGGGAGAUUAUAGGUUURGGGAAGUUAGUARGUGGAGUGUUGGG UUUTUTGAAGGAGGUUTGRGRGGUGAUUUUTRGAAGGGUAUUUAGUAAAGUUUAGAGU AGAUUAGGUUAUUGRGAGUUUU |
| 87 | GRGGGGUUAGUAGRGUUGUURGGRGGGAAGRGGUAUAGGRGUUURGGGAAGURGRG UAUUUAGUUGUUUAGUAUUAUGURGUUUAGGUUGGURGUGUUUUUUTGRGARGGGT TGAAGAUGRGGARGAAUUTUUUURGGUAGUUUAUAGUUAXGAUUUUUAGGUUUGTR GGGUUGGGAAGAGAGGGAGARGUUGUGAGGAGAUGRGGURGGUUUAUUURGUAUAGU TGRGRGUUUURGUUURGGAAAUUUAGUUUUAGUURGGRGURGGAGGUUUGGGUUAUURC UUUUUUAUUUUTGUAGGAGUUU |
| 88 | GAAUUUUUTGUAGAGGUAAGGGGRGAGUUGAUUUUAAGUUUURGGRGURGGAUUGGAG UUGGUUUURGGGRGGGGRGRGUAGUUGUTGRGGGUGGAUURGGURGUAUUUUUUUAUA |

| SEQ ID NO: | Sequence |
|---|---|
|  | GRGTUTUUTUTUTUUUUAGUURGAUAGGUUGAAGAUXGUGGUGUGAGUGURGG<br>GAGAAGUURGUURGUAUUUUAAUURGURGUAGGAGAGUARGGURGAUUGAGRGG<br>UAUGGUGUGAAGUAGUUGGUGRGRGGUUUURGGAGRGUUUGUAURGUUUURGU<br>RGGGUARGUUGUUGGUUURGU |
| 89 | AGGAGUGUUUGGGGUGUUUUUUUUGGUUGUAGUGGGAUAUAGGUGUGUUUUUUA<br>GGAAUUGGGUUUUGAUUAUUUUUAGUUUAAUAUUUURGGGUUUGUGAAUGUGAU<br>UUGUGUURGGGAUGGGUUUUGUGGGUUUGUUUUAUUUXGUAUGUGUGGAUUGG<br>UUAAGUGGGUGAAGGUAAGGURGGUAGAGUUGAGUUUUGUUUGUUUUUUU<br>UUGGGUUAGAUGUUAUAUUAGGGUUUAGUGAUUUAUAGGGUAGGUAGUUGGGAAAU<br>AUUAGGUAGAGGGUAGGUUUUG |
| 90 | UAGGAUUUGUUUUUGUUGGUAUUUUUAAUUGUUUGUUUUAUGAGUUAUUGGGU<br>UUGGUGUGGUAUUAGUUUAGGAGAGGGGAUAAGGUAGAAAUUAAUUUGAURG<br>GUUUAGUUUUAUUUAUUUGGUUAGAUUUAGUAGUGXGGGGAUGGGGUAGAUUU<br>AUAAAAUUUAUUURGGUAUAUAGGUAUAGUUUAUAGGGUURGGGAGUGUUGGGGU<br>GGAAGUAGUUAGGGUUUAGUUUUUAGGAAGGUAUAUUGUGUUUUAUGUAGUUA<br>AGAGGAAGUAUUUUAAAUAUUUU |
| 91 | GUAGGAAUAGGUUAGRGUAUGUAAUGAAAAUUUUGRGUUAUUUUUAGAAGGAU<br>GUGAUUGUAUUUAUGAGUAUGUAGUAGGGUUAUUAUAUAUUUUUGUUUUGGGU<br>UUUUUUUUGUGUAGUUUAGGUUURGGUUUGUGUUXGAGGGUUAGAXGGUUUUA<br>UGGUUUUUUAGUUUUUUURGUAGAUUAUAUAGGGAGGUAGRGAGGUAGGGUGUAAG<br>GAUGUUAGGGGUGGAAGGGGUGAUAURGGGAGUAAAGAUUGUAUUUUUGGUUU<br>GGAUAAAUUGUUGAUAUU |
| 92 | GAAUGUAGAUAGGUUUAUUUAGGUUAAGGGGUAGUAGUUUUGUUUGGUGUUGUA<br>UUUUUUUAUUUUAAUAUUUGUAUUUUGUUUGUUGUUUUUUUUGUGUGAUUUA<br>RGGAGGAAAUGGGGGAUUAUAGGGURGUUGGUUUUGXGAGUAUAAAUXGGGGUUU<br>GGGUAUAUAUAGGGGAGGGUUUAGGAGUAAAAGGUGUGUGGUGAUUUUGUGU<br>AUAUUUAUAAAAUAUAGUAUAUAUUUUUAAAAGAUAARGUAAGAGUUUUUAUUA<br>UAUARGUUGGUUGAUUUUGU |
| 93 | UGAUUGUAUUUUAUGAGUAUGUAGUAGGGUUAUUAUAUAUUUUUGUUUGGGUU<br>UUUUUUUUUGUGUAGUUUAGGUUUURGGUUUGUGUURGAGGGUUAGARGGUUUAU<br>GGUUUUUAGUUUUUUURGUAGAUAUAUAGGGAGGUAGXGAGGUAGGGUGUAAGG<br>AUGUUAGGGGUGGAAGGGGUGAUAURGGGAGUAAAGAUUGUAUUUUUGGUUG<br>GAUAAAUUGUUGAUAUUUUURGAUUUUGAAGUUAUUUAUUAUGGUUGRGUUGGU<br>UUAGAUAUUUAAGGGUUAUUUU |
| 94 | AAAGUGGUUUUUGAAGUGUUUGAGUUAGRGUAGUUAUGAUGGAUGAUUUAGAGGU<br>RGGGAAUGUAGAUAGGUUUAUUUAGGUUAAGGGGUAGUAGUUUUGUUUUGGUG<br>UUAUUUUUUGAUUUUAAUAUUUGUAUUUGUUUXGUUGUUUUUUUGUGUGAU<br>UUARGGAGGAAAUGGGGAUUAUAGGGURGUUUGGUUUUURGAGUAUAAAURGGGG<br>UUUGGGUAUAUAUAGGGGAGGGGUUUAGGAGUAAAAGGUGUGUGGUGAUUUUGU<br>UGUAUAUUUAUAAAAUAUAGUUA |
| 95 | UAUAUAUUUUUAGUUGAGGGGRGUUGAGGUUUUGUGUUGUGUGURGUUUUGAU<br>UUGUUUUUUUUUUUGAUAGAGAGUUAGUUGUUUURGGGAAUAAUUUAUUAAUG<br>AGUGUAAUAUUUAGGUAAUUUAUGUGUAGUAAUGGAAGGUGUAUUGGGRGU<br>UUGGUAGUGUGARGGGUUGUUGAUUGUUURGAUAAGAGUGAUGAGAAGGAGUGUR<br>GUGAGUGGUUUGGUUUUUGUUGGGGUGGGGUGGGUGGAGUUAUUUGGGUAGAGGGGG<br>AGUAGGUUUGAGUAGGUUUA |
| 96 | UAAGUUUGUUUAGGAUUUGUUUUUUUUUGUUUUAGGAUGGUUGUUAUUUUAUUUU<br>AGUAAAGGGUUAGGUUAUUUARGGUAUUUUUUUAUAUUUUGURGAAGUAGUU<br>AGGUAGUURGUAUAUUGUUAGGRGUUURGGGAUGUAUXGUUUAUUGUGUAUAUG<br>AAGUUUUUGGUAUGUUGUAUUUAUUGGUGAAGUUGUUUURGGGGAGUAGUUGGUUU<br>UUGUUAGAGAGAGGGGAUAGGGUUAGARGGUAUAGUAAUAGUAGGGAUUUAGRG<br>UUUUUUUAAUUGAAAGGUGUGUG |
| 97 | UAUGUAUUUUGUGUUUGUAGUGUGUUGGUUARGGGAGUAUUUUAAAUAUAUUAUGGG<br>URGGGRGUAGUGGUURGGUUUUGUAAUUUAGUAUUUUGGGAGGUUGAGGRGGGUA<br>GAUUAUUUGAGUUUAGGAGUUUXGAUAUUAGUUUGGUUAAUAUAXGXGAAAUUUXGU<br>UUUUAUUAAAAAUAUAAAAAAUUAAURGGGUUGUUGAUGGRGRGUGUUUGUAUUUUUAG<br>UUAUUAGGGAGGUUGAGGUUAGGAGAAAUUUUGAAUUUGGGAGGUAGGGAUGUA<br>GUGAGUUAAGAUUUGUGUUAUU |
| 98 | AGUGGUAUAAUUUUGGUUAUUGUAGUUUUUUGUUUUUUAGGUUAGGAGAUUUUUU<br>UGUUUAGUUUUUUAGUAGUUGGGAAUAUAGGUUARGRGUUUAUAUAUURGGUUAA<br>UUUUUUGUAUUUUUAGUAGAGAXGGGUUUXGUXGUGUUGGUUAGGUUGGUGUXGAAU<br>UUUUGGGUUUAAGUGAUUUGUURGGUUUUAGUUUUUUAAAGUGUUGAGAUUAUAGGU<br>RGGAGUUAUUGRGUURGGGUUUAUAAUGUGUUUAGAGUGUUUURGUGGUUAGUAUAU<br>UAUAAAUAUAAAAAUGUAUG |

| SEQ ID NO: | Sequence |
|---|---|
| 99 | GGAUTGTGGGUUUUTTGGTTTGTGTUTGAAAGUTGGGGGTAUAGTTUTGUATGGGTT GGUUUUTGUUTTAUUTRGGGAAGUTUUUAGAGUUTGUTGGGUAGUUTGUUTUUTU UTUTUAUUTUUTUXGTUTUUAUTUUUTUUTAUUAUAUUURGGUTUTUUUARGGUR GGAGGUXGTGAATGGGUTGUTTGTTGUURGGUUUAUAUAGGAGGATGGTGGUAG AAGAUUURGGUAUAAAGUUAGUAUUUAUTUTGTUUUUAGGUGGGUUUAGGGAGG UTGAAAAGUUAUUUAGUTGTG |
| 100 | UAUAGUTGAAGTGGUUTTUAGUUTUUUTGAAUUUAGUUTGGGAAUAGAGTGGGTG UTGAUTTTGTGURGGGGTUTTUTGUUAUUAUUUTUUTGTGTGGGURGGGUAAUAAA GUAGUUUAUUUARGGGUUTURGGURGTGGGAGAGURGGAAUGTUGGUGAGGAGGGAG TGGAGARGGAGGAGGUGAGAGGAGGAGGUAGGUGUUUAGUAGGUUTUTGGGAGUT UUURGAGGUAAGGUAGGGGUUAAUUUAUGUAGAAUTGUAUUUUUAGUTTUAGAU AUAAAUUAAGGGGUUUAUAGTUU |
| 101 | TAUTUTUTTGATGTATGAUUTTGGATGTGATTTAGUUTUTUTGGGUUTTGGUUUKUU TGAAUUATGTGAUUAGAGUAUUAAGURGGUUTUUUARGUTGGUUTGAGUTGUTUAA GGGUUAUAUAGGUUUTUTTTGUUUUAAGUUAGAGGTXGUUUTUTUUURGGUUAAGUR GRGGUTATGGGGUGGTGGUAUAAUAGAGAGUAUAGGGGAUUTUGAAUAUAAAUAU TGGGUUAUGAUUUUTGUUUTGGUUAUUTUTTGGUUGUUGAUUTUUGAUUUUTUTGTUTUU UUUTTUGUGAATGGGGGGAGT |
| 102 | AUTUUUUUAUUUAUAAAGGAGGAGAUAGAGGGUUAAGGUUAGUAGUUAAGAGUG GUUAGGUAGGGGUUAUGAUUUAGUGTTGUGTUUUAAAGUUUUGUGUUTUTUGTTG TAUUAUUAUUUUAUAGURGRGGUUTUGGURGGGGAGAGGXGAUUTGUUGGUUUGGG AUAAAGAGGAUUUAGAUGGUUUUUGAGUAGUUUAGAUUAGRGUGGGAGGURGGUU TGGTGUUTGAUAUAUGGUUAGRGGGGUUAAGGUUUAGAGAGGUUAAAUAUAUAU UUAAGGUUAUAUAUAAGAGAGUA |
| 103 | GUUAUGGAGAAAAUAUGUUAUGUTUUUAUGGAAAUUAAUUUAUTTGUUTAAUUTGAGGTUUTG GGGGUGGUUUGAUAUUUAGUGUUAAUUAGGGGGGAGUUTGGUTGUGAGGUGGUUAGUAGUUA GRGGUGUTGURGGUUGUUGTUUUUAXGUAXGUAGGUUGUTUGUGUGUAGUUTGUUTTGUUAAUTUGUU AGGUAAUTGGGAUAGGUUAGAUAUGAUUUAGGUUUAAGUAUARGUAUUUAUUUUUUUUR GURGAGGGUAUTUUURGGTUGUUAUAUGUUGAUTUTGUUUAGRGUUAGGUUAGUAUAGUUUA |
| 104 | TGGGUTGUUTGGRGUTGGGUAGAGUUAAUAUAUGGUAURGGGAGAGUUGUUTRGGRGGGGGAG GGTGGATGRGTGUGTUUUGGAGUUTGGGUUAUGUUTGUAUUTGUUUUUAGTTGUUTGGUAGATT GGUAAGGUAGGUTGGUAGAGUUTGXGTGXGTGGGAGGUAGURGGUAGUAURGUUAUGTGUT GARGAUUTTUAUAGUUAGAAUUUUUUUTGGTTUAGUAUTUGAGUTGUUAGAAUUAUUUUUAGAAUU TUAGTTAAGUAAAUAGGUTUGGTTTUUAUGGAGAUAUGGUAUAUUTUUTUUUAUGGU |
| 105 | GAGTUTGGUTGUGAGGTRGUUAGUAUAUGGGRGGUTGUTGURGGUTGUUUTUUUUARGUA RGUAGGUUTGUUUAGUUTGUUTTGUUAAUTUTGUUAGGUAAUTGGGAUAGGTGUAG AUAUGAUUUAGGUUUAAGUAUARGUAUUUAUUUUUUUXGURGAGGGUAUTUTUUR GGTGUUAUAUGUUGAUTUTGUUUAGRGUUAGGUAGUUUAGRGUUAAUUUUUUUUT UUUUUAGUUUGGUUUUAARGUAUAGUGUUUUAGUUTUTGUGGGUAGUGUGAGGAGTG GUAAUTGUAGGUAUUUUAGAAG |
| 106 | UTTUTAGGGGUGUUTGUAGAUUGUUAUUTUUUUAUAUUAUUUAGUAGAGGUUAGAGUA UTGUGRGTGGGGUUAGGUTGGGGAGGGGGAGGUGGGRGUTGGGUGUUUGGRGUT GGGUAGAGUUAAAUAUGGUUAURGGGAGAGUUGUUTRGGXGGGGAGGGUGGAUGRG TGUGUUTUGGAGUUTGGGUUAUGUTUTGUAUUTGUUUUAGTTGUUTGGUAGAUUGGUA AGGUAGGUUGGUAGAGUUTGRGTGRGTGGGAGGUAGURGGUAGUAURGUUAUGTG UTGARGAUUTUAUAGUUAGAUGAUU |
| 107 | GURGAAUUUGGAGGGUGRGAGUAUUUUTUUUUTUAGURGUAUTGUAUUTGUURGTAG GTGAUUAAUUUAGGGRGGAUUUUUAGAUUUAAUUTUTUUAGAGUUAGGGUGGG AUGGGUAGGGAUAGGAGURGGAGGUUUUAUTGGUUURGGGXGAAGGUAUUUTGGA AAGUAUUUAGAGRGUUUAGUAUUUUTUURGRGGUUUAUUGUAGGUUGAUGAUUU UTGGGUAGAUUUUTAGAUUAAUUUAGUUUAGGGRGGAUUAAGGAGTGGGAGAUA AGGGAGURGGUTGGUUURGUTGGUUU |
| 108 | GGGUUAGRGGGGUUAURGGUUUUUTTGUUUUUAUTUUTTAAUTURGUUUTGGAUTG GATTGAGTUTGAGGGTUTGUUUAGGGGTRGGTUAGUUTGRGGGTGGURGRGGGAGG GATGUTGGARGUTUTGGATGUTTTUUAGGATGUUTTXGUURGGGGUUAGUAGGGUU TURGGUTUUTGTUUUTGUUUAUUUAUUUTGGUTUTGGAGAGGAUUGGGTUTGGGG GUURGUURGTGGGUUGGUAUUUAUGGGUAGGUGUAGUGRGGUUGAGGGAGGGGTG UTRGGUUUTRGGGAUUAGGU |
| 109 | TTGUUTGAUUAAAAGAAUGUAGUAGAUAAUUTTGAGAUUTGGAGUUAGGUUAUA AGARGAUUUUTGGGTTTUTGUGGAAUUTUTGUUTUUTGAAAGAAAUAAGUUAUUAAGT GGURGGGUGAGUTGGUUAXGUUTGUAAUUUAGUAUUTTTGGGAGGUUXGAGURGG GUXGAUAUAAGGUUAGGAGAURGAGAUUAUUUTGGGUTAAUAUGGUGAAAUUURG TUTUUAUUAAAAUAUAAAAAAAAUUAGURGGGUAUAUGTGGRGGGRGUUTGTAGTUU UAGUAUUURGGGAGGUTGAGGU |

-continued

| SEQ ID NO: | Sequence |
|---|---|
| 110 | GUUTAGUUTUURGAGTAGUTGGGAUTAUAGGRGUURGUUAGTATGUURGGUTAAT<br>TTTTTTGTATTTTAGTAGAGARGGGGTTTTUAUUATGTTAGUUAGGATGGTUTRGATU<br>TUUTGAUUTTGTGATXGGUURGGUTXGGUUTUUUAAAGTGUTGGGATUAUAGGXGT<br>GAGUUAGUUAUURGGUUAUUTGGTGGUUTGTTTUTTTUAGAARGAGAATTUUAUA<br>AAAUUUAGGAAATRGTUTTGTGAUUUAGUTUUAGGTUTUAAAGTTATGTUTGUTGU<br>ATTUTTTTGGTUAAGUAA |
| 111 | AGAATUTGUUTAGUAGGRGGUTUTUUUUTGUTUUUUUAURGAGUAUAUAUKUIUU<br>GAGGGGAUUUTGRGGGAGGAGGGUTGUTTUAGTUTUUAGAGAUUAUUUUAUUUT<br>AUAGRGAUUUUUUTATGAURGUUUUUUAUURGGTGUTUTXGGGUUARGGGGAAGG<br>GAUAUTRGGGAAAGAUAUUAGAGAURGGGAGGGTGUAGUTGGGUTUTTRGRGGGG<br>AGRGGGRGGGAGGUUTTUUTGTTAUATGTRGUAGUTGGGAUAUAGARGGUAGRGUT<br>UUAGGGUUUAUUTGURGGUUTRG |
| 112 | RGAAGURGGUAAGTGGAUUUTGGAGRGUTGURGTUTGTGTUUUAGUTGRGAUATGT<br>AAUUAGGAAGGUUTUURGUURGUTUUURGRGAAGAGUUUAGUTGUAUUUUURGGT<br>UTUTGGTGTUTTUURGAGTGUUUTUUURGTGGUUXGAGAGUAURGGGTGGGGG<br>ARGGUAUAGGGGAGTRGUTGUAGAGATGGGAGAUGGUTUTGGAGAUTGAAGUAG<br>UUTUUUURGUAGGGUUUUTUUUARGGUTGUGUTRGGTGGGGGAGUAGGGGAG<br>AGURGUUTGUTAGGUAGAUUT |
| 113 | AGGUUUAGGUAGAGGUUAGAGUUUAAGUUUUTGUUURGAAGGAAAUGUGUUUAU<br>GUUAAUUAUUUAUAGUUGAGGUUGGAGGGAAGUUAGGGAUUUTGGGAUUGGUUA<br>UUUTGGUUTUGAUUAUUAUUGUUURGGAGAUUUAAAXGUAUUUTGAGUUAUUAGA<br>XGTGGGUGTUAAUAUUUGAGGUUAAUUUUUTGAXGUUUUAGGGUUGUTGGAGGAA<br>GUUGGUUUUUUUUUUUAUUUUUGUUUUURGTGUUAGUUUGGUAUAGAGUUAAGGG<br>GUUUGGUUGGGUUTGGUUGGG |
| 114 | UUAGUUAAGUUUAGUUAAGUUUUUTGAUUUTGUAUUAGGUTGGUARGGAAAAUAG<br>GAGGUGGGAGGGAGGAUUAGUUUUUUUAGAGUAGUURGGAAGXGTUAGGGGGUUG<br>AUUUAGGUGUUAAUAUUUAXGTUTGGUGGUUAGGGUGXGUTUAGGTUTURGGAA<br>UAGUAAUGAGUUAAGGUUAGGAUAAUUUAGUUUUAGGGUUUTGAUUUUUUUUAG<br>GUUUAGUAUGGAGUAGUUAGUAUGGGAUAUAUUUUUUTRGGGAUAGGGUUTGG<br>GUTUTGAUUUTGUUTGGGUUTG |
| 115 | UUUATGUUAAUAUTUUATAGUTGAGGUUGGAGGGAAGUUAGGGAUUUTGGGAU<br>TGGUUAUUUTGGUUTUGAUUAUUAUTGUUURGGAGAUUUAAAXGUAUUUTGAGUU<br>AUUAGAXGTGGGUGUUAAUAUUUGAGGUUAAUUUUUUTGAXGUUUUAGGUTGUUTG<br>GAGGAAGUUGGUUUUUUUUUUUUUUUUGUUTUURGTGUUAGUUTGGUAUAGAGT<br>UAAGGGGUUUGGUUGGGUUTGGUUGGGUUAGAAAARGUGGUAGUUAGGAGUUAGU<br>UTGRGGGUAGRGGGGTGUTGGG |
| 116 | UUUAGUAUUURGUTGUURGUAGGUUTGGUTUUUUAUTGUUARGUTTUUTGAGUUUAG<br>UUAAGUUUAGUUAAGUUUUUUTGAUUUTGUAUUAGGUTGGUARGGAAAAUAGGAGG<br>TGGGAGGGAGGAUUAGUUUUUUUAGAGUAGUURGGAAGXGUUAGGGGGUUGAUUT<br>UAGGUGUUAAUAUUUAXGTUTGGUGGUUAGGGUGXGUTUAGGTUTURGGAAUAGT<br>AATGAGUUAAGGUUAGGAUAAUUAGUUUUAGGGUUUTGAUUUUUUUUAGGUUT<br>UAGUUATGGAGUAGUUAGUAUGGG |
| 117 | UTUTUUURGUAGTTTAUATURGTUUTUUUUUURGUUUTGRGAGUTGGGUTUGGGGAR<br>GUUTGGGUGGAATGUAGAUUUAUAGGUTGUUTTGGTGUUUTUUUUTUUUTGUTUTU<br>UAGRGUUUUAGUUUUAGAUAUUAGUUUUUUAGRGGGXGAAAGUUURGGGAGRGUU<br>TTUUURGAAAGAUAUUAGGGTGUUARGRGGUUUUTGUUUTGUAGAAGUAUUUUUU<br>TUURGUUUUTGUUTGGAAAGUAGGUUUUTUUUTAAGUTUTGRGUUUTTUTTUUUTG<br>GGRGUUUTRGGAURGTGGUURG |
| 118 | RGGGUUARGGTURGAGGGRGUUUAGGGAAGAAGGGRGUAGAGUUAGGGAGGGGU<br>UTGUTTUUAGGUAGGGGRGGGAGGGGGAUGUTUTGUAGGGUAGGGGURGRGTG<br>GUAUUUTGATGTUTTTRGGGGAAGGRGUUUURGGGGUTUTXGUURGUTGGGGGAUTG<br>GTGTUTGGGGUTGGGGRGUTGGAGAAUAGGGAGGAAGGGUAUUAAGGAUAGUUTG<br>TGGGUTUTAUAUTTUAUUUAGARGTUUUUAAAUUUAGUTRGUAGAGGRGGGGAGGA<br>GGARGGATGAAAUTGRGGGGAGAG |
| 119 | AGAGGAGUGGGGAGRGUAGUAGGGTGGUUUURGUTUURGUUAGAGGAGUGGUU<br>UTTUAAGGUUAGGUUUAGGRGGGTRGGGAAUAGAGAUUUGGGAAUGUGGGUUGGA<br>UTGGGAGUAGAGUUAUUUAGUAUGAGUUAUTUURGUUUXGURGGAUTUTTRGURG<br>UTGGUUUTRGUUTGURGUUUTUUUUTGGUUUTGGUUUTGGUUUTGRGUUUTUUUT<br>GUAGAGUUGGUURGGGUGGGUTGGRGGUUUUAAUURGUUAUAAGRGUAUAGGGUT<br>UTGUUUAUTUUURGUUUUTTTU |
| 120 | GAAAAGGGGRGGGGAGUGGGUAGAGUUUUTGTGRGUUUGTGGRGGGUTGGAGGURGU<br>UAGUUUAUURGGAUUAGUTUTGUAGGGAGGGRGUAGAGGGUUAGGGUUAGGGUUA<br>GGGGAGGGGRGGUAAGRGAGAGUUAGRGGRGAAGAGUURGGXGAAARGGGAATGAU<br>TUATGUTGGGUGGUTUTGUTUUUUAGUUUAGUUUAUAUTUURGGGTUTUTGTUUR |

| SEQ ID NO: | Sequence |
|---|---|
| | GAUURGUUTGGGUUTGGUUTTAAAGGGUUAGUTUUTUTGAGRGGGAGRGGGGUU<br>AUUUTGUTGRGUTUUUUAUTUUTUT |
| 121 | GURGAGRGRGGTGGUTUATGUUTGTAATUUUAGUAUTTTGGGAGARGGAGGTGGGT<br>GGATUAUUTUAGGTUAGAAGTTTGAGAUUTUTGTUTUTAUTGAAAUTATAAAAAT<br>TGGURGGGUATGGTGGTGGGTGTUTGTAGTTUUAGUTAXGTGGTAAGUTGAGGUAG<br>GAGAATGAUUTGAAUURGGGAGGRGGAGGTTGUAGTGAGUUAGGATTGRGUUAUT<br>GUAUUUAGUUTGGGAGAUAGAGTUAGAUTUTGTUTUAAAAAAAGUTATGGGUU<br>TGUAGGATGUUTAATATAAAG |
| 122 | UTTTTATATTAGGUAUUUGUAGGUUUAUAGUTTTTTTTGAGAUAGAGTUTGAUTU<br>TGTUTUUUAGGUTGGAGTGUAGTGGRGUAAUUTGGUUAUUGUAAUUURGUUTU<br>URGGGUUAAGUUAUUUUUGUUUAGUUAUUAXGTAGUTGGAAUUAUAGAUAU<br>UUAUUAUUAUGUURGGUUAAUUUUTATAGUUUAGUAGAGAAUAGAGGUUUUAAU<br>TUUTGAUUUGAGGUGAUUAUUUAUUUURGUUUUUAAAGUGUTGGGAUUAUAGGU<br>AUGAGUUAURGRGUUTRGGU |
| 123 | UARGUUUGUTUTUAUUUUAUGUUUGUUUGUATAUUGGUUURGUUUUUUAGAU<br>AGUAAUAGUAGAAUUAGUGAAAGUAUUAAAGUUUUGAUUUUUGAGAAGAGUAU<br>AGAAGAAUAAUGARGUAAGUGUUUUUUUUAGUUXGGUAUUUAAAAGGGAAA<br>GGUUUUUUGUURGGUGGAUARGUGAUUAUAUGAUUUAUAAUAUGGAGAUGAGA<br>UUAUAUUUUUAUUUGUUUUUTGUUUGUAUAUAAAUAAGRGRGAUUA<br>GGUAUURGGGGUUAUUGUU |
| 124 | GGUAGUGGUUURGAAUGUUTGGUGRGUTGUUAUUAUUGUGUAUAAGGUAAAGGG<br>GUAGGGUAAGGAGUGUGAGUAUUUUAGUGAUUAAUAAGGUUAUGUGAGUUARGU<br>GUUAUURGGAUAGGGGGUUUUUUUTTAGGUAGUXGAGUTGAGAGAGGAUAG<br>UTTARGUUAUUAUUUUUUAGUGUUUUUAGAAAGAAAUAAAGAUUUAAUAUUUU<br>AUTAAUTUTGUTAUUGUAUUAGAAGGRGGAGUUAGGGUAUAGAGUAGAAUAUG<br>AAAGUGAAAUAGGAGRGTG |
| 125 | AGUUUUGGGRGGGGUURGGGGAGUAGGUUURGUAUUGGAGGAUAGGGUGUGAU<br>UUAUUGAAUUUGUAAAAGUAAAAGURGAURGARGGUUGUGGGAGGTTTGAGGU<br>UTGGRGGGGRGGUUURGGGAAGTGAUUGUUGGUXGUTAGGXGRGXGUTGGAAAUU<br>UTTTUUAUUUGRGGAGUUUAURGGAGUTGUGAURGGAGGAGGGAAUUUUUAGGU<br>AGGGAGGAURGUAGGGUUTUTTUAUTRGUUUGAGGGGUUUGGGGUUTGGGGAG<br>UAAUUTGGGGUGAUUUAUTTU |
| 126 | GAAATGGGUAUUUUAGGUUUGUUUUUUAAGUUUAGGUUUAGGAGGAGAGUG<br>AAAAGGUUUTGRGGUUUUUUTGUUGGGGGAAUUUUTUUUTURGAUAUAGUUR<br>GGTGGGUURGUAGAUGGGAAAGGGUUTUUAGXGRGXGUUTAGXGGUUAUAAAUU<br>AUTUUURGGGGURGUUURGUUAGGUUTAAAAUUUUUAGAGURGUAGGURGGUTTU<br>TAUTTAAGAGGATTAGATGGGUAUAUUUTGUUUUUAAAUGRGGGUUTGUU<br>UURGGAUUURGUUUAGGGGGUU |
| 127 | UATUUAUAAAUUUUUUAGGUUUUUTAUTUTTUURGUAUAGUTGUUURGGTGUT<br>UUAGAAAGAUTGGAAAUGAGGTGAGUUUUUTGGAUUUUGUUGUUAUUGUAA<br>AUATUAUGTGGUTGUAUUGUUUTUUTGUUUUTUUTTUXGUUUAGGUUAAUUUTU<br>UUAUUUUTTAATTGUURGGGGAUAUUAUUUAUUTUAAAAUTTTUUAUGGUAUUUT<br>UUTUUUAUAUAAGUUUUUTAGUTGUTTURGTUTTTAAUUAAUAUUTUUUGGU<br>TUUAGUTAUTGUUAUTTUAT |
| 128 | ATGAAGTGGUAGTAGUTGGAGUUAGGGAAGGTGUUGGUUAAAGARGGAAAAUAGU<br>TGAGGAGGUUTGUGTGGGAGGAGAGGUAUUAGUTGGAAAGGUUUAAGUAAUTGGAGAT<br>UUURGGGUAATTAAGGGGGUGGGAGGAUUGGUUTGGGAXGGGAGGAGGGAUAGGA<br>GGGUAAGUAGUAUUAUAUGAUAUUUGUAGGUGGUAGGUAGGGAUUUAAGGGAGUT<br>UAUUTUAUTTUUAGUTUUUUTGGAGUAURGGAGGUAGAUTGUGRGGGAAGAGTGAG<br>GGGGUUTGGGAGGTTTGTGGAUG |
| 129 | UTTUUUUAGGAUTGUUTTGGUUUUUTGGUUUUAGUTUTGGAGGAUTUUUGUTUAUTT<br>UUTURGUUUUUAGGTGAGUTGAGAAUUUAUTGRGRGRGGGGAUUUTGUTGRGUUTG<br>UUUUUURGGGUTGUAGAGGGUAGGAXGUAURGUUAGGUAAGGURGRGGUUTGXG<br>UTGAUGUUAUUURGGGAGRGGUGGUTGRGGGGGAGGAGGGRGAGUAUTGGARGG<br>GGGUAGRGGAGUGUAGGGUGUGAGAUUTAAAAUAGAGGGUUUAAUTGGAGGGUUTG<br>UUUAGAAGGRGGUAGUAUAUTGG |
| 130 | UUAGUGUGAUTGURGUUTUTGGGUAAGUUTTUAGTGGAGUUTUTGTTUAGAUT<br>UAUAUUUUAUAUTURGUTGUUUURGTUUAGTGUTRGUUUTUUTUUUURGUAGUUA<br>UURGUTUURGGAGUGGUAUUAGXGUAGAGURGRGGUUTTGUUTGGRGGTGXGUUTT<br>GUUUUTGUAGUURGGGAGGGUAGGRGUAGUAGAGUUURGRGRGUAGUGGGUUTT<br>UAGUUUAUUTGGGGGRGGAGGAAGUGAGUAAGAGUUUUUAGAUTGGGGUUAGGG<br>GGUUAAGGUAGUUUTGGGAAAG |
| 131 | TTTAGGGUTUTUUTUUUTGGUUTUUUUUUUTUUUURGUUUUUUTTUUTTGRGGUTGA<br>UTUUAGUTUUUUUTRGGUGUURGTAAUUUTUUTTTUUTUTTTTGUXGUAGTUTUXG |

| SEQ ID NO: | Sequence |
|---|---|
| | TUTUTUTTUUAUAGGGTUTUTUUUTUUUUUTUTUUURGTGGTUGTUAGAUTTUTUU<br>TGGAUTTUTURGUUURGUAURGUUXGUUURGGATGURGAGRGTGGTAGAUTUTGU<br>AGURGGGUTUUTRGUTGUURGUTGGRGUTGUUUAUAUUUUUTTGGGUTUUUUTUUA<br>AGGTUUUUTURGUTRGU |
| 132 | GRGAGRGGAGGGGAUUTTGGAGGGGAGUUUAAGGGGGTGTAGGUAGRGUUAGRGG<br>GUAGRGAGGAGUURGGUTGUAGAGUTUTAUUARGUTRGGUAURGGGXGGGRGGT<br>GRGGGGRGGAGAAAGTUUAGGAGAAAGTUTGAUAAUUARGGGGAGAGGGGGAGGG<br>AGAGAUUUTGUGGAAGAGAGAXGGAGAUTGXGGUAAAAAGAGGAAAGGAGGGTTA<br>RGGGUAURGAGGGGGAGUTGGAGUTAGUURGUAAGGAGAGAGGGAGRGGGGGAGG<br>AAAAGAGGRGGGAGAGAGAUUUTAAA |
| 133 | GAGGGUUAUAGTAAAUTGGAUAAGTTTTTUTGUUUAGUUUAGGUTGUUAUUTGTAG<br>GTUAUUTGGGUTUUAGUTATGTGGUTGUUTUTTUTGUTGGGTGUUTTAUTUTGGGUA<br>GTGUTGTGGTTGUTUAGGGAURGGUTAGAGUUTGUUXGUUAGUAATGUUTTTGTUTT<br>UAUUAURGGUTGTGAUTUAGGUTTTGGGRGUUTUTGGUAUTGUAGUTGGAUUAGA<br>GAGGUTTURGAGTUUTGGUUAGUTGUUTGAUUUUUTURGGGGURGAGGAUUTGUA<br>GRGGGTGGUUTUUTUURGUU |
| 134 | GRGGGAGGAGGUUAUURGUTGUAGGUUUTRGGUUURGGAGGGGGTAGGUAGUTG<br>GUUAGGAUTRGGAAGUUTUTUTGGUUUAGUTGUAGTGUUUAGAAGGRGUUUAAAGU<br>UTGAGTUAUAGURGGTGAUGAAGAUAAAGGUAUTGUTGGXGGGUAGGUTUTGURG<br>GTUUUTGAGUAAUUAUAGUAUTGUUUAGAGUAAGGUAUUUAGUUAGAAGAGGUAG<br>UUAUAUAGUTGGAGUUUAAGUGAUUUAUAGGUGGUAGUUUAGGUTGGGUAGAAAA<br>AUTTGUUAGUTTUAUTGUGGUUUTUA |
| 135 | GTTUTGGUTTUAUTTTTTTTTTUUUAAAAUTGUUAUTTTUAUUTGUUUAUUAGAGUUUAG<br>AAUAUGUAAAGAGUUTUUTTUAAGUAGUAGGUGGUUUUAUAGAGUUUAUAGAGAAG<br>GAAAAUUAAAUAUAUUURGGAUGUAGUUUAUUAXGAUXGUGGAGGAGUUAGAUUA<br>UTUUTURGGGUUTTUGUTGUGUTGUUTGUGAAAUAGGAAAAGGGAGAAUUGAGGUAAU<br>GAGUUAUUUAUUTGGGUUUAAAGUAUUAUUUUTARGUUGAAUAUGGAGAAAAUGUGA<br>AGUAAGAGUUUTUUTTTUA |
| 136 | TAAAAAGAAAUTUUTTGUUUAUAUUTTUUTUUAUAUUUUAARGUAGGUGGUGUUUGGG<br>UUUAAGUGAGGUGAUUUAUUGUUUAGUTUTUUUUTTUUTGUUUUAUAAGUAGAUA<br>UAGUAAAGUUAGGGAGAGUAAUUTGAUTUUTUUAXGAUXGUAGUGGAUTGUAUURGG<br>GATGAUAUUUUAGTUTTUUTUUTUTUTUGUGGGUUUTGUAAAAUUAUUAUTGUUUAAAGA<br>AGUUTTUUGAUAUGUUUUGAAUUUAAGAAUAAAUGAAAAUGGUAUUTUGGGAAAA<br>AAAAAAUGAAGUUAGAAU |
| 137 | UUTUUUTUUAGUUTUUTGUAUAUAUAUUUAGGUTGGUAUUUAUUGUAGGUGGGGAUUUTU<br>UTUTTTGGGUUTUGGAGUUUUUUUUUGUGTUTUUTGUAURGGGGAGUUUTUUTUUUT<br>UTGUUUTUUTUUUUUTUUUTUUTUGUAUUAAAAAUTUUTUXGUUUUUAAAAAUUAUUUUAAR<br>GUGUGUTURGTGTUGTUUAUTUAAAAURGGRGGUAGGAUUAAGAAUUUUTUTGUGT<br>GUAUUUUAUAGAGUURGUAUGAUAAUUAAGAGUUGAUUAUUTGGGUUAUUUTUUATAU<br>UAUUAGTGURGUAUUUUA |
| 138 | TAAATGRGGUAUUAATGGUAUGAGAAUGGUUUAGGUAGUUAGUUUTTTGAUUAUUAU<br>ARGGUUTGUGAUGAGUGUAGGGAAUAUAAAGGGUUUUTUGAUUUTGURGURGGTTUAGAU<br>AAAAAUAAUARGGAUAUARGUGGAGUGGUTUUUAAGGAGXGGAGAGUTUAAUGAGUAA<br>GAAGGAAGGGGAGAAGAUAGAAGGAAGAAGUUUURGGUAUGAGAUAUAGGGAG<br>GGGGGGUUUUAAAGUUUAAAGAGGAGGUUUUUAUUTGUAAUGGAUAUUAGUUTGGT<br>AUAUAUGUAAAGAAUUGGAGGAGG |
| 139 | AAGGUUAAAGTRGUTGUUAGAUUAAGGUAAAURGUGGRGAGGUAGUUGUUTGRGU<br>RGUUAGAGUGUGGGUGUGAAUAGUTGGAGUUAGUGGUUUUTGGAGAUUAGGGAUU<br>AUUUTGUAUUUUAUUAURGGUUTUUAUUUUARGUAUAXGUAGUAUGAUUTGGGUTTU<br>UUUUTUAUAGUGGAAUGUAAGUGUUUAUAUUTUAGURGGGGUAGUUUAAUUAT<br>GGUUTGUGGGUAUUAUUUUAUUTGUAGUUTGUTTTTTGAGUUTAAGAAUGUUGUUGAU<br>AUTTTTAAAAAAUAGAAUA |
| 140 | GTTUTUTGTTTTTAAAAGTGUAAUAAUAUUTTUAGUTUAAAAAUAGGUTGUAGGUG<br>GGAUGGUGUUUAUAGGUUAUAGUUGGUTGAUUUURGGUUAGGGUTGAGGUAUUAGU<br>AUTUUAUTGUAUAAAGGGAAAUUUAGGUUAUAUTGXGUGUGRGUGGGUGGAAGU<br>RGGAUGUGGAAUAUAGGUGGUUUUTGAGUTUTUUAGGAAUUAUUTGAGUTUUAGUTGT<br>TUAUAUUUAUAUUTGRGGRGUAAGUAAUUUAUUTRGUUARGGUUUAGUUTUGGTUT<br>AGUAGRGAUUUUAAUUTTG |
| 141 | GAGAUAGGGUUUAUUUTGTRGUUUAGGUTGGAGUGUAGUUUAAUUUUTGGGU<br>TUAGUGGAUUTUUUAUUUAGAUUUUTGAGUAGURGGGAUUAUAGGUAUARGUUA<br>UUAGGUUUAGUUAAUUUUTUTGUAUTUUUUTGUTGUAGAGAXGAGGUUUTRGUTAGGUrGUU<br>UAGGGUTGGUTUTUAAUUUTUTGGGUUUAAGXGAUUUUAUUUUAUUTUAGUUTUUUAAAG<br>UGUGGGGUUAUAGGGUUTGAGUUAUAGXGUURGGGUTGAAAGUGAAGUUGAAUGAGA<br>UGAUTRGUUUAGGUUAUAU |

-continued

| SEQ ID NO: | Sequence |
|---|---|
| 142 | ATGTGGUUTGGARGAGTATUTUATTUAAUTTUAUTTTUAGURGGAXGUTGTGAUT UAGGUUTGTAAUUUUAGUAUTTTGGGAAGUTGAGGTGGGTGGATXGUTTGAGUUUA GGAGTTAGAGAUUAGUUTGGGUAUUTAGRGAAAUUTXGTUTUTAUAAAAAAATA UAAAAAATTAGUTAGGUUTGGTGGRGTGTGUUTGTAGTUURGGUTAUTUAGGAGTU TGAGGTGGGAAGATUUAUTGAGUUUAGGAGGTTGAGGUTGUAUTUUAGUUTGGGR GAUAGGAGTGAAAUUUTGTUTU |
| 143 | AUARGUUAUUAGGUUTAGUTAATTTTTTGTATTTTTTGTAGAGAXGAGGTTTRGOT AGGTTGUUUAGGUTGGTUTUTAAUTUUTGGGUTAAGXGATUUAUUUAUUTAGUT TUUUAAAGTGUTGGGGUUAUAGGGUUTGAGUTAUAGXGTURGGUTGAAAGTGAAGTT GAATGAGATGAUTRGTUUAGGUUAUAUGGUAAUTAGUTGGUTGATTGARGUUAAAGT TGATTTUATTUTTUTUAATGGGUTUAGAGTUUAAATTUTGGAAUUTAGAAGARGTT GUTATTUTGGTTUUAAGU |
| 144 | UTTGGAAUUAGAATAGUAARGTUTTUTGAGGTTUUAGAATTTGGAUTUTGAAUUUA TTGAGAAGAATGAAATAAUTTTGGRGTUAAUTAGUUAUTGATTGUUATGTGGUUT GGARGAGTATUTUATTUAAUTTUAUTTTUAGURGGAXGUTGTGAUUAGGUUTGT AAUUUUAGUAUTTTGGGAAGUTGAGGTGGGTGGATXGUTTGAGUUUAGGAGGTTAGA GAUUAGUUTGGGUAAUUTAGRGAAAUUTXGTUTUTAUAAAAAAAATAUAAAAAATT AGUTAGGUUTGGTGGRGTGTG |
| 145 | AGTGAUTGUAGRGTUAGGUUAAGUTTGGUUAUUTAUATGTUTGGUATGAUAGTGGU UTAGAGTAUTRGTUTGAGAAGAAGAGUTAUAUUTGAGRGUTUTGGAGAAUUTAG URGGAGUTTUAGGUAGTUTGGGAGUUUAUAUGGAGGXGTGTAGGUUTATGTUTUA TGTUUARGTTGUURGGGAGAUAAAATUUTTTUTTTATTTAGAGUTGUUUUAAAATG UTGUAUUAGUTUUTAUTGRGGTGGUUTAUUTTAGUATAUAGGTATGTGGARGGU UAUTGTGUTGGUTAUUTT |
| 146 | AAGGTGAGUUAGUAUAGTGGURGTUUAUAUAUUTGTATGUTAAGGTGAAGUUAUR GUAGTGAGAAGUTGGTGUAGAAUAUTTTGGGUAGUTUTAAATAGAAAAGGATTT GUUTUURGGGUAAARGTGGAUATGAGAUATAAGGUUTAUAXGUUTUUATGTAGGUUU UAGAUTGUUTGAAAGUTURGGUTAAGGUTUTUUAGAGRGUTAGGTGATAGUTUTTU TTUTUAGARGAGTAUTUTGAGGUUAUTGTUATGUUAGAUATGTAAGTGGUUAAGUT TGGUUTGARGUTGUAGTUAUT |
| 147 | RGGGUAUUTAGGUTUTRGUURGUUTGUAGURGUUTGGGGARGRGGGTTURGGARGGU TGGRGRGGGGRGGGGRGGGGAUUAURGAGUAGGAAGTUUURGRGGAAGRGURGUR GGGUAUAGRGTGGGTGUTGTRGAGGAGTGGRGUURGGGXGGGGRGGGAGGTTATA AATAGRGGURGUUAUUTUGTTUTUTTTUAGAUAUAUTTAATTTAGURGGUAGGUAU ARGGATGUUATTTTTAAAAAAAGAAUTTGTTTTATTGRGUTRGAGGTGAURGGGAA GGTGUUURGRGGGTUAUTRG |
| 148 | RGAGTGAUURGRGGGAUAUUTUURGGTUAUUTRGAGRGUAUAAAAUAAGTTUT TTTTTTAAAAATAAGUATURGTGTGUUTGURGGUTAAATTAAGTGTGUTUTGAAGAGA AGUAGGATGGRGGURGUTATTTATAAUUTUURGUTGUURGGGRGUUAUTUUTRG AUAGUAUUTARGUTGTGUURGGRGGRGUTTURGRGGGGAUTTUUTGUTRGGTGGTU UURGUUURGUUURGRGUUAGURGTURGGAAUURGRGTUUUUAGGRGGUTGUAGGR GGGRGAGAUUTAGGTGUURG |
| 149 | GAAGGTGRGGTGRGGTGAGGTGAGAAGAGAGAURGRGUTAGAUUAGGRGATGTUTT AGGGARGGGAGAGGGGTGAGGUUUARGGRGGUUUTGGGGAGRGGUUUARGAUGG UUUARGUAGAGUTGTAGUUAGTGAAUAGGAAGTATTGGXGAGAGGGAUTGAGAA AUUUAAGAGAGTGTGGGGTGAGGAAAAGGTUAAGGAAGGUUUAGGUTTUUAGGAA GGGUUTGGGURGGGGRGGGGRGGGTGGTGGGAGGUAGTGGTTAGGARGGGRGGGG GTGGGGGTGGGGGTGGGGTAGGG |
| 150 | UUUTAUUUUUAUUUUUAUUUUUAUUUURGUURGTUUTAAUUAUTGUUTUUUAUUA UURGUUURGUUURGGUUUAGGUUUTUUUTGGAAGUUTGGGUUTUUTTGAUUTTT UUTUAUUUUAUAUTUTUTTGGGTTTUTUAGTUUUTUTXGUUAATAUTTUUTGTTUAU TGGUTAUAAGUTUTGRGTGGGURGGTRGTGGGURGUTUUUUAGGAURGURGTGGGU UTAUUUUTUTUURGTUUUTAAGAUATRGUUTGGTUTAGRGRGGTUTUTUTTUTUA TTTTTTTATTRUATURGUAUUTU |
| 151 | GAGAAAUAAAATAUATTTTTTAATTTAAAAAAAAGTAUUAGAATGAATAAAAUAGG GGUTTTUUAAAAUTGUTTTTGGTAGATTTAGUAAAUUTAUTGAAUTTTAGAAAUTTTU ATTTTATAATTGTURGGAGATAGAAAGUAGTGUTTUXGAATAAGTGGATAAUTUTGU RGGUUUUAGTAGGTGUUATTGGTGAGUAUAUAGGGGTTGUTTAAGTUTUTAAGTUAT TTUUUTGAUTGUGGTTTGAATUAAUGTUAAATATUTAUAGGGGUUAGGUAGGUAAU TUAAUTGAAGUTGAAAUAGG |
| 152 | UTGTUAUTUATTGAGUUAUUTGUUTGAUUUUUTGUAGAUATTUGAUAUTGAUUUA AAUUUAUAGUUAGGGAAATGAUUUAGAGAAUUTAAGUAAUUUUTGUTGUGUUATUAAUTG GUAAUUTAUTGGGAURGGUAGAGUUTAUUUAUUTAUTTXGGAAGUAUTGUUTTUATAUT URGGAUAAUTATAAAAATGAAAGUTTUTAAGTTUAGTAGGUTTGUTAAAUTUTAUUAAA |

| SEQ ID NO: | Sequence |
|---|---|
| | AGUAGTTTTGGAAAGUUUUTGTTTTATTUATTUTGGTAUTTTTTTTTAAAUUAAAAAA TGTATTTTGTTTUTUT |
| 153 | GGAGGGUUUAURGUAGRGUAGRGTARGUUTGRGGGURGGGGRGGGAGAGGGAU RGTRGRGTTTGTGURGUUAGUAUUTGRGGUUUUUAGRGUAUURGGGUUUUARGRG GTAGUUUUUAGGGGAGTGGGGAGTRGGGRGGGAAAUAGUTXGUURGGGUUUUTARG GGTGUUUUTTRGURGRGUTUUUTUURGAGGGTUUTTGUAGTRGGGRGTGGAAGT GGGATGAGUAAAUUURGUAGUAUAGGGUUTTRGUUUUAGGAUUTGUAUUUTUTAU RGGUUARGGGARGTUUUTURGUAU |
| 154 | GTGRGGAGGGARGTUURGTGGURGGUAGAGGGTGUAGGUUUGGGGRGAAGGUUU TGTGUTGRGGGGTTTGUTUATUUUAUTUUARGUUURGAUTGUAAAGGAUUUTRGGG AGGGAGRGRGGRGAAAGGGGUAUURGUAGGAGUURGGGXGAGUTGTTTUURGUUR GAUTUUUUAUTUUUTGGGGGUTAURGRGTGGGGUURGGGTRGUTGGGGGURGUA GGTGUTGGRGGUAUAAARGRGARGGTUUUTUTUURGUUURGGUURGUAGGRGTAR GUTARGUTGARGGTGAAGUUUTUU |
| 155 | AGAUAUAAAGAGGGRGGAGAGAUAGAUAUAGAAAGAGGGAGAUAGRGGGGUTGG ATGGARGTGTGGURGGGUUAGUGGGGAGGAGAGARGAGTURGUAGAUAGRGTTUA GAGGURGRGUTGUTTTGGGTGUTGAGURGUUURGGGGTTUAXGGTRGUAGTTTGTUU TTAUAAAARGUUUAGURGUUURGAUUTGTGGTGUUAGGGAGGAUUTAUUTGGUTG TGURGGTUTGAGAAGGGGUUAGUGAGGGUURGGTGRGGGTARGGGRGGGTGUAGAT GUAGUUAGGAGGARGGGRGGGAGU |
| 156 | GUUURGUURGUUUTUUTGGUTGUAUTGUAUURGUURGUAUURGUAURGGGUUTU AUTGGUUUUTUTAGAURGGUAUAGUUAGGUAGGUUUUUUTAAGUAUUAUAGG TRGGGGRGGUTGGGRGTTTTGTAAGGAUAAAUTGRGAUXGTGAAUUURGGGARGGU UAGUAUUUAGGUAGRGRGGUUUTGAARGUTGUTGRGGAUTRGUTUTUUTUUU UAUTGGUURGGUUAUARGTUUAUUAGUUIRGUTGUTUUUTUTITUTGUTGUTGT UTUTURGUUUTUTTTGTGUT |
| 157 | GUTGUAUAUTGAGUTGUTTAAUAUTTAAGAUGUUGGUGGAUGGUAAAGUTAAAG AGUAUTGUAAUAUAUGAUUTUTGGGGUUURGGAGUTAUGAGUAUUUUTTUTAGAU AUAGURGTGGGGUUAUAUAGAATTUTGUTUUTGUTGUXGUURGGAAGUAUTUATUT GGUUUUTGUAUUUAUTAUUTGUAUUUTUUUUTUUUARGAGGTGUUAAGAGUTGT GGGATGAGUAAAGGAGGUUTGUGAAGGATTTUUTGTTTUAGTUUUAUAUTTAAGGTUT GAGTTUTUTAGAGGAAUTTT |
| 158 | AAGATTUUTUTGAGAAUUTAGAUUTGAATGUAAGAUTGAAAUAGGAAAUUUTUAU AGGUUUUTTTAUTUAUUUUAUAGUUUUTAAUAUUUTRGTGGGAGGGGGAGGAUGUA GGTGAGUGGGUGUAGGAGUUAGAUGAGUGUTTURGGGXGGUAGUAGGAGUAGAAT TUTGUTGGUUUUARGGUTGUGUUUAGAAGGGGTAUUAUGAUTURGGGAGUUUUA GAGGTUATGTGTTAUAGTGUUUTTAGUTTTGUUAUUUAUUAAUAUTTTAAGTGTT AAAUAGUTAGTGTGAUAGU |
| 159 | UAGGGUTGGGAGAAUAGGAUGGAUAGRGTTTTGUUAGAGUUUUAUGGGAAGUTTUU TTTUAGGUAGUTGAAUUUAUTTUAGGGGUUAGGGAGUAUUGAUUAGGGGTTGGGAUA TTGUUURGGGAGGAGGAUGAGGAUGUTTUUUAGGGUUTXGGUTGAUTUAUGGUAGUGA GTATTAGTUAUTUUUTUAUAAGAAUTAGUUUAUAUUTUTAGTAGUUTUTTGTUTU UUAGAGGUUUUTGUUUUAUGTTTAUUTGUUTGAAGUUUTUTUURGGURGUUUUUA UUUAUAUURGUAUAGUUGG |
| 160 | UAAAUTGUGRGGAUGUGGGTGGGGGGRGGURGGGAGAGGAGUUUAAGGUAGGUAAA UAUGGGUUAGGGUUUUGGGAGAUAAGAGGUUAUUAGAGGAUGUGGGTGATTUT TGTGAGGGAGUGAUUAAUAUUUAUUAUUAUGAGUAGUXGAGGUUUGGAAAUAUUU TUAUUUTUUTUURGGGGUAAUGUUUUAAUUUUUTGAUAGUTGUUUUUTAUUUUTGAA ATGGGTTUAGUTGUUTGAAAGGAAGUTUUUUAUGAGGGUUUTGGUAAAARGUTGUU AUUUTATTUTUUUAGUUUTGU |
| 161 | GAGGAUUAAAAGAAGUUUAGAGAUGUTGGUUAAUUGAUAUAAAAAUAAAGAGUUAA GGGAGAGGTUGAGAGAGGGAGAGUAAUAUUUAUGGGTGUTGGAAUUTTTTAAAGGG UUAGAGGAGGAGGGGGURGGGRGTGGUGGUUUAXGUUTGUUATUXGAGUAUTTTG GGAGGGUUAAGGTGGGUAAAUUAARGAGGGUUAGGAGTTTGAGAGUAGUUUGAUUAAU ATGGUGUAAUUURGUUUTATAAAAAAUUAAAAAUUUAGURGGGTGUGGUUGUTG UUTGUAAUUUUAGUUAUTUAGG |
| 162 | UUTGAGUAGUTGGGAUUAUAGGUAUAUAAUUAUAUURGGUUAAAUTTTGTATTTTT AGTAGAGARGGGGGUUGUAUUAUGUUGGGTUAGGGUTGUTUTAAAUUUUTGAUUUTRGT GATTTGUUUAUUTTGGUUTUUUAAAGTGUTXGGAUAAUAGGXGTGAGUUAUUARG UURGGUUUUUTUUTUUTUTGAGUUUUTTAAAAATTUUAGAUAUUUATAGATATTGU TUTUUUTUTUTUAAUUTUTUUUTTAGUTUTTTATTTTTGTGTUAATTGAUUAGUAUUT UTGGUTTUTTTTAGTUUTU |
| 163 | UUAGGAGUURGUUTGGGAGRGRGUAGRGUUUTAGGAGURGAGAGURGUGUTTGG UUUTRGUTGGURGGGTAAAURGAGGGGAAGUTUUTGGUUTUUTTTUUUTTAAGUUU |

| SEQ ID NO: | Sequence |
|---|---|
| | UTTATTGUTTUTGTGGGGAAGGUUUTUUTAGGTAGAGGXGAAGGAURGGGGAGATA<br>AUUTUTUUUATGGGUUAUAUAUAURGUTGUUAUGGUUUGUGUGGUGUUAGAAGGUAUUU<br>UTUAGUUUTUAGUGURGUGAAAAAUTGUAUAUTUAAGAAGGURGAUUGAUARGUUU<br>AARGUGGUAUAGUAAUUUAGU *(see image — best effort)* |
| 164 | AUTAAAUUTGUGUTGRGARGUUAGGRGUGUUAAUUGAUUUUUUUGAGUGUUAGAUUUU<br>TUARGGUAUUGAGGGUGAGAGGUAUUUUUUUGGUARGAUAUAGAUUAUGGUAGRG<br>GAUGUGGUUUAUGGGAGAGGUUAUUUUURGGUUUUXGUUUUAUUUAGGAGGGU<br>UUUUUUUAUAGAAGUAAUAAGGGGUUUAAGGGAAAGGAGGUUAGGAGUUUUUU<br>RGGUUUAUURGGUUUAGRGAGGGUUAAGUAGRGGUUUUGGUUUUAGRAGRGUGURG<br>RGUUUUUAGGRGGGUUUUUGG |
| 165 | GAGGUARGAAGUGURGGGAGUAUUUAGUUUAUUUUAGGAAAGAUAUAGRGAAU<br>UAURGUUAAUAAAAUAAAGUAAAAUAAAAAGUUGRGUUAUGUGAARGGAAUGGGA<br>AAAUUGUUUUUGUAUUAAUUUUGAUUGAAUUGAGUXGGUAAUUUUUGAAURGGU<br>UAUUGAUAUAAUAAUAGGAAAUAUUUAAUUGUUUUUGUAUUUUAAAUAUAAAUA<br>GUAGGUUUUUAAGUAGUAGUAGGRGAUGUGUGAUAAGGUUAGAUAGAGRGUAGA<br>UAAUGAUAUUUAUUAG |
| 166 | UUGAGUGGGUGAUAGUUGUUGRGUUUGUUGAAUUUUGAUAUAUAURGUUAUU<br>GAUUGUUAAAAAUUUUAUUAUUUAUGUUUAAAGGUGUAAGAAAUAGUUAAAUGUUUU<br>UUAUUUGUUGUAUUAGUGAAURGGUUUAGAGAUUGUXGAUUAAUUUAAUAAAAUUA<br>GUGAUAAGAGAGUAAUUUUUUAUUUGUUUAGAUAUGGRGAGUUUUUUGUUUUGUUU<br>UGUUUUAUUGGRGGUGAUUGRUGUAUUUUUUUAGAGGUAAAGUGAGUAGUUGG<br>GUAGUUUGRUGUUU |
| 167 | GAUUUUAGUUGRGGGUGAUAURGGUGGGRGUGGGGUGUGGUUUAGAUAGUUUUU<br>UUUUUUURGGUUGGUUGUUAGGUUAAUAURGGGUGGGAUUAGUUUUGGUGURGGU<br>AGUAGUUUUAUGUUUURGGUUUUGGGGUUUUGUAUGXGURGUUUUUAUAUUUGG<br>UGUUUUUTUUAUUUURGUUUUAUUUGUUURGGGUUAAUUGUUUUUAAGUUAGA<br>AAUUAAGGAUAGUAUUUUUUUUUUAGAURGUUUGGUGUAGUUUGGGAUGGGRGU<br>UUUUAGUGRGUUUAGAURGGGU |
| 168 | GUURGAUAUAGGRGAUUAGGAGRGUUUUAUUURGGGGAUUGUAGUUAGGRGGUUGG<br>GAGGGGGUGUGUGUUUUAAUUUUUGGUUUGAAGGAUAGGUGAUUGGGAUAGGUGG<br>AGARGGAAGUGAGAGGGGUAGUUAGGUGAUGGGARGGXGUAUGUAAGAAUUUAA<br>AGGURGGGAGUAUGGGGUUAUUGURGAUAUUAGAGGUAGUUUUAUURGGUGUUG<br>AUUUGGUAAUUAGURGGGGAGGAAGGAGGAGUGUGUGAGGUUAUAUUURGARGUUUA<br>URGGUGUAUURGGAGUGAGGUU |
| 169 | GUAUUGUGUAAUUAGRGGUUUUAGUUUGGUUUAUUUAGGGUUGAAGUUUAU<br>UAUAGAAUUUUUAGUAGUARGUGGGUGUAUAGUAAAGAUUAGUUUUGGAUAUAG<br>URGGGUGUUAGGGRGGGGUGAGGGGGGUAGGAGGUAGGAXGUAGGAGGUGAGUUG<br>URGGGRGGGGUAGGAUGAGGGAGUUUGUAUUGUAGAGUUAAGGGGGAGAAUUA<br>UAGUAUUUUAAUUAGUUUUUGAUGGUUUUUAAAGUUUUUAAGUUUUUUUUUUUU<br>UUUUUUUUUUUAUUUUUAUAAG |
| 170 | UUUGUAGGGAUAAAAAAAAAAAAAAAAAAAGGAUUUAAAAGGUUUUGGAAGUU<br>AUAAGAGUUAAUUUAGGGUGUGAUGAUUUUUUUUUAGUUUUGUAAUGUAGGAU<br>UUUUUAUUUGUUURGUURGGAUAGUUAUUUUUGXGUUUGUUUUUGUUUUU<br>UUAUUURGUUUGAGUAUURGGUGUGUUAGGGUUGAUUUUUGUUGUGUAUUUUA<br>RGUGUGUGGGGGUUUGUGUAGUAGGUUUAGGUUUUGGAUGAGGUUAGGUGAGA<br>AURGUUGGUUGAUAUAGAUAU |
| 171 | GAUUAAUUUGUUUUGAUAAGUUAUAUUUUUUAGUUUAGUAUUAAGGUAGAAGAG<br>AGUUUUUGUUGAAGAGUURGUUUGUGUUUUGUGGUAAAGAUAUAGGUUUAURGGUUU<br>UUUXGUGGGUUUUAGUGUGAGAAGGGUAUAGGUGGUUGGUGAGAUAGUGUUUUGU<br>UUGAUAGAUUUUUUAXGUURGGAUUUUUUUAGUUUGUAURGGUUAUUUGUAUGG<br>UUUARGGAAGAGUUAGAAUUUGUUUUAAUGUUGGUUAGUUUUAUUAUUAGUUUG<br>AAAAGAAUAUAGAAUUUARG |
| 172 | RGUAAGUUUUGUGUUUUUUAAGUAAUGAUGGAAAUUGGUUAAUUAAAAAUAGA<br>AUUUUAGUUUUUURGUGAAAUUAGUUAGGUGGURGGUUAGAUUGGAAGGAUURG<br>AGXGUGGAGGGGUUUGUUAAGUAGGGUAUUGUUUUAGUUUAGUUGUUUGUGUUUUUGU<br>AGUAUUGGGAUUUAXGGAGAAGURGGUAGGGUUUGUGUGUUUUAUUAUAGAAUAUAA<br>GRGGGUGUUUUUAAUAGGGUUUUUUUUUGUUUUAGUAUUUAAGUUAAAGGGUAUGAUUU<br>GUUAGGAGGUAAGUUAAUU |
| 173 | GAUUAUAGGUGUGUGUAUUAUGUURGGGUAAUUUUUAUAUUUUUGGUUUUAUUAU<br>GUUGUUUAGGUUGGUUUUAAAUUUUGGGGUUAAGUGAUUUUUUGUUUUAGUUUU<br>UUAAAGUGUUGGAUUUAGAGGUAUGAGUUAUUUGUAXGUUUGUUUUUGAUUUAG<br>GUUUUUUARGGAGUUGGUUAUUUUUGGGUUUUGRUUUAGURGGUGUGAAGGUGAGU<br>UAUGUURGAUGAUGAUUUGAGGAGUAGAAGAAGGUUGAGGUGAGUUAAUUUGAGGG<br>GAAUUGGGGUUAUGAUUAGAG |

| SEQ ID NO: | Sequence |
|---|---|
| 174 | UTUTGGTUAUGAUUUAGUUUUUUUAGGUGAUUAUUUGUAUUUUUUUGUUUU<br>UAGGUAUAUAUGAGUAUGAUUAUUUUAGUAUGGUUGAGRGAGGUUUAGAAG<br>AUGAUUAAUUURGUGGGGAUUUGAGGUUAGGAGGUAAAXGUGUAAGGUGGUUAU<br>GUUUUUAAUUUAAUAUUUUGGGAGGUUGAGGUAGGAGGAUAUUUGAGUUUAGGA<br>GUUUGAGAUUAGUUGGGUAAUAUAGUGAGAUUAAAAAAUAUAAAAAUUAUURGG<br>GUAUGAUAGUAUAUAUUUGUGGUU |
| 175 | AGGAAGUTRGAGGUUAGAAGUUGGGUGAUUGUUAAAGGUTRGUUAUUUARGGUGAG<br>GGUUAGGUUUUGGGAGGGUUGAGGGGUAGGUAUGGUGAGUUAGUUURGGGUAUGA<br>GGUAAGGRGUGGUAGGUUUGGGGGUAAAAGUUAUAGUUXGUGUGGAGGGGGUGGG<br>GGGAURGAGGUUUUGGGAAGUUGUUGGAUUUGGUGUAGUGUGGGUGUGAUAUT<br>GAGUGUTURGGGGAUTURGAGUUAUAUUUAGGUAUGGUUAGUUUUARGUTUUU<br>TUUTUUAGGUAUUUGGUTUUUUG |
| 176 | AGGGAGUUAAGUAUUUGGAGGAGGGAGRGUGGGGUTGGUUAGUGUUUGGGUGAUA<br>AUTRGGAGUUUURGGAGUAUUUAGUGUUAUAUUUAUAUTGUAGUUAGAAUUUAUA<br>GGUUUUUUAAAGGUUUUGAUUUUUUAUUUUUUUAUAXGGGUUGUGUGGUUUUUGUU<br>UUUAGGUUUGUUARGUUUUTGUUUUAUGUURGGAAUUGGUUAUUAUGUUUGUUUUT<br>UAGUUUUUUAGAAUUUGGUUUUAURGUGGGUGGRGAUUUUGAUAAGUUAUUU<br>AAUUUUUAAGUUURGAUUUUUU |
| 177 | AGUUARGGRGAUUAUUAUUUUAUUUUUUUUAUUUUUUUUUUGUAGGUGGUU<br>TTTTTGGUUAGUGUGUUUGAGUGUUAUUUUUUGUUUAGUGUUUGGUGUURGGUT<br>UTUUUUTUUUUUUUUAUUTUUUGGGUUUGGGUUGUXGUUURGGGUUUUAGGT<br>UTAGAUAUAAGGGTTGAAUGAUUAGAUTGUTGGUTUGUUAGUUUUAUGUGGUUT<br>RGGUUUAUUUUAGUUTUGGUTGUUTUUUUUAAAGUUTUAAUTAAGRGAGAUAUA<br>UAGUAAUUTGUUUUUTUUUT |
| 178 | AGGGAGGGGGUAGAGUUAUUGUAUGAUUUURGUGUGATTGAGAUUUUGGGGAGGUA<br>GUUUAGAGUUTGGGGUGGGURGAGGUUUAUAUGAAAUTGAAUAGAUUAGUAGUUTGG<br>TUAUUUAAUUUUTGUGUUUAGAUUUGGAGGUUURGGGGAGXGGUUAGGUUUUAGGUUUA<br>GGAGAGUTGAGGAGGAAGAGGAGAGURGGAGUAUUUAGGAUAUAGAGUAAGAGGT<br>GAGUAUUUAGGUAUAUTGGUUAGAAGGUUAUUUGUAGGAGGAGGAGGUGGGGGA<br>GGAUGGAUUGGUUGGTRGURGUGGUT |
| 179 | AAGGUGAAUGUUGUAAUUUUUUUUUUUAGUUUUGUAGURGAUUUUGAUAUAAAU<br>UUUUTGAAGUUUAGUGGUUUUUUUUAUGUAUUUAUUAUUUAUAUUUGUGU<br>AAGAAAUUUAUAAUUUGGAURGGGAAUAGAAUUGGAXGUGUUAAAAUGUUUGAGGA<br>UAUUUUAUXGAAUGUGGUUGGUUUGAUGGGAAGUUGGUAUGAAUAGAAAUGUAGG<br>AGUUTUUUUUUXGAGGUUUUAAGUUUUGUGUUUUGAUUAAUGGUURGGAUUGAG<br>AUUAGAUGAGUUAAGUUUA |
| 180 | GAAUUTGAUUUAUUGAUUUAAUURGGAUUAUUUGAGUUAGAAAUAUAAAGUUUGA<br>AAUUTXGAGAGGGAAGAUUUUUGAUAUUUUUAGUUAUGUUAGUUUUUUAUAAGUUU<br>AGUUAUAUUXGAUGAAGUUGUUUUAGGUAUUUUGGUAXGUUUAGUUUGUUUURGGT<br>UUAGGUUGUGGUUUUUUUGAAAGUAGUAGGUGUAGGUGGUAGGUGUAUGGAAAGAG<br>GUUAUUGAAUUUUAAGGAGUUUAUGUUAGGGAUGGUUGUAGGGUUGAGGAGAGAG<br>GGUUGUAGUAUUUAUUUU |
| 181 | UAGUUUUGUAGURGAUUUUGAUAUAAAUUUUUGAAGUUUAGUGGUUUUUUUUUA<br>UGUAUUUAUUAUAUUTGUGUTUUAAAGAAAUUUAAUUUGAURGGGAA<br>UAGAAUUGGAXGUGUUAAAAUGUUUGAGGAUAUUUAUXGAAUGUGGUUGGUUUGA<br>UGGGAAGUUGGUAUGAUUAGAAAUGUAGGAGUUUUUUUUTXGAGGUUUUAAGUT<br>TTGUGUUUUUGAUUUAAUGGUURGGAUUGAGAUUAGAUGAGUUAAGUUUAGAUGAUU<br>AUGUAAAUUTTTAGAUGGGG |
| 182 | UUUUAUUTUAAAGGUUUUGUAUGGUUAUUUGAAUUTGAUUUAUUUGAUUUUAAUURGGA<br>UUAUUTGAGUUAGAAAUAUAAAGUUUGAAAUUTXGAGAGGGAAGAUUUUUGAUAUUT<br>UUAGUUAUGUUAGUUUUUAUUAAGUUAGUUUAUUAUUTXGAUGAAGUUGUUUUAGGUA<br>TTTTGGUAXGUUUAGUUUUGUUUURGGUUUAGGUUGUUGGUTTUUUUTGAAAGUAGUAG<br>GUGUAGGUGGUAGGUGUAUGGAAAGAGGUUAUUGAAUUUUAAGGAGUUUAUGUUAG<br>GGAURGGUUGUAGGGGUTG |
| 183 | UUUAUUAUUUAUAUUUTGUGUTUUUAAAGAAAUUUAAAUUUGGAURGGGAAUAGAAUUGGA<br>XGUGUUAAAAUGUUUGAGGAUAUUUAUXGAAUGUGGUUGGUUUGAUGGGAAGUTGGUAUG<br>AUUAGAAAUGUAGGAGUUUUUUUUTXGAGGUUUUAAGUUUUTGUGUUUUGAUUUAAUGGUU<br>RGGAUUGAGAUUAGAUGAGUUAAGUUUAGAUGAUUAUGUAAAAUUUUTAGAUGGGGUUAAAA<br>UUAAAUUTGUGUUUUTAAAUUAUUUUAAAUTGUGUUUAUAUUUAGUUAUAGUUU |
| 184 | AAAUUTAUAAUUGGUGAUGAAUAUAUUTGGAAUGGUUUGAGAAUAUAGAUUUGGUUUUAGGUU<br>UUAUAUUUAAAGGUUUGUAUGGUUAUUUGAAUUTGAUUUAUUTGAUUUUAAUURGGAUUAUUGA<br>GUUAGAAAUAUAAAGUUUGAAAUUTXGAGAGGGAAGAUUUUUGAUAUUTUUAGUUAUGUUA<br>GUUUUUUAUAAGUUAGUUAUAUUTXGAUGAAGUUGUUUUAGGUAUUUUGGUAXGUUUAGUUU<br>TGUUUURGGUUUAGGUUGUGGUUUUUUTGAAAGUAGUAGGUGUAGGUGGUAGG |

| SEQ ID NO: | Sequence |
|---|---|
| 185 | GAGAGGGGAAGGGGURGAUUAUUTGUTUUGRAGUUATTUTRGGGUTRGGUUAGUU<br>ATTGGGUTGGGAAUUTGTUAAUUUTGGTTGATUTTUUAATGAGUTGTGAAUTGGTUT<br>TURGGGAGGAUUUAUAGGAGGUTGGAAARGGGGUUTGGXGRGRGUTTUUUTUTAG<br>TGRGAGGUTGAUTGGTTGGAUTRGURGGGUTUTAUTGTGGGUUUUARGUTATGTTT<br>AGARGUURGARGTGTUUUAUUTTATTGAAUTRGTUUTGUUUUUUAAGTAGGGARGA<br>TTTAUUTUUATTTTUTAGAT |
| 186 | ATUTAGAAAATGGAGGTAAATRGTUUUTAUTTGGGGGGUAGGARGAGTTUAATAAA<br>ATGGGAUARGTRGGGRGTUTAAAUATAGRGTGGGGUUUAUAGTAGAGUURGGRGA<br>GTUUAAUUAGTUAGUUTRGUAUTGAGAGGGAAGRGRGXGUUAGGUUURGTTTUUA<br>GUUTUUTGTAAGTUUTUURGGAAGAUUAGTTUAUAGUTAUUGGAAGATUAAUUAG<br>GATTGAUAGGTUUUAGUUUAATGGUTGGURGAGUURGAGAATGGUTRGGGAGUA<br>GGTGGTRGGUUUUTTUUUUTUTU |
| 187 | RGGGGGUAGGGAGUAGAUUTGAUUAGTGGRGTUAGTGUTAUUTUAAAGRGGUAG<br>RGUATTTUATTAAAAAUTGATGTAGAAATTAUUUTGGGUTTTGTTTTGUAAAGAGU<br>ATTTGUATAAGAAAAAAUAAUAGURGGUTAATTUUUUXGTUUAUTGGUAGGAAGA<br>GAGAUAGUUTTAGAGAGTTTGGGAUTUTUUAUUUURGGAGAATTAAAAGUUTUR<br>GAGAUAUUUAUTTTAGAAGTTUTGGTUAATRGTTUTTAAAGTGRGGUAGAAGAUU<br>UUTTGRGTUTGAATGGTTTG |
| 188 | UAAAUUAUUUAGARGUAAGGGGTUTTUTGAURGUAUTTAAGAARGATTGAUUAGA<br>AUUTUTAAATGGATGTUTRGGAGGUTTTTAATTUTURGGGAATGAGAGAGTUUA<br>AAUTUTUTGAAGGUTGTUTUTUTTUUTGUUAGTGGAXGGGGGAATTAAURGGUTGA<br>TTATTTTTTUTTATGUAAATGUTUTTTGUAAAAUAAAGUUUAGGGTAATTUTAUAT<br>UAGATTTTTAATGAAATGRGUTGURGUTTTGAAGTAGUAUTGARGUUAUTGAGTUA<br>GGTUTGUTUUUTGUUUURG |
| 189 | UAGTGTUGTAGAUUTATTAATTAUAGGATAATTARGGARGGGGAAAUUAGAUAU<br>AGATAUAAAUAGTGUUUUUUUUAUUUUUURGUAUARGUUUUUUURGGTUTUUUTG<br>AUAUUUTGGTGTGUAUTGTGUTUUUUUTGUUAUAUUUAAXGUTGRGGUTUUTAUTAGA<br>UUUAUUUUTGURGGTGUUAAAATGUUUAAAGGAAGGUTGAGTUATGUTUTGGUUT<br>GUUUAGURGUAATAGTUATGUTGUAAUTUUUARGGAAAAUUTUUTTUAUUUAUTU<br>UAGAGGTUTGAGAUAUUUTAA |
| 190 | TTAGGGTGTUTUAGAUUUTGGAGTGGGGTGAAAGGAGGTTTURGTGGGAGTTGUA<br>GUATGAUTATTGRGGUTGGGUAGGUUAGAGUATGAUUAGUUTTUUTTGGGUATT<br>TTGGUAURGGUAGGGGTGGGUTUAGTAGGAGURGUAGXGTGGAGATGGUAGGGGA<br>AUAUAGTGUAUAUUAGGATGUAGGGAGAURGGGAGGGGRGTGTGRGGGGAGGTG<br>GAGGAGGGUAUTGATTGTATUTGTGTUTGGATTTUUURGTURGTAATTATUUTGATA<br>ATTAATAGGTUTAUAAUAUTG |
| 191 | GGAAGGAGRGAGUTTUTTTTATAGGAGUUUUAGTTUUTRGTTTTGTTUTUTTRG<br>TTATTUTUUAAGAAAGURGGUTUTTGAGTUAGUTGGUAGGAGAGRGAGGRGAATG<br>RGUTGGTGUTGGURGUAATGGUUURGGTTUAARGUTXGUTUUAGUTGGUARGTUU<br>TUAURGGGRGGURGGRGGUUTGUUTGUUUARGUTUTGUUAGGAGUUUAGGTUAG<br>UUUUTTGUUTRGURGGGGURGGAGUURGTUUAAAAUAAUAAGTUTTTGUUTUT<br>UUTTTGGARGUTGTATAATT |
| 192 | AATTATAUAGRGTUUAAAGGAGAGGUAUAAAAGAUUTGTTGATUTTGGARGGGUTU<br>RGGUUURGGRGAGGUAAGGGUTGAUUTGGGUUUUTGGUAGAGRGTGGGUAGGUAG<br>GURGURGGURGUUURGGTGAGGARGUTGAUUAGUTGGAGXGAGRGTUGAAURGGGG<br>UUATTGRGGUUAGUAUUAGRGUATTRGUUTRGUTUTUUTGUUAGUUGAUTUAAGAG<br>URGGUTTUTTTGGAGAATAAUUTRGAAGAGAAUAAAAARGAGGAAUTGGAGUUUTA<br>TAAAAAGAAGUTRGUTUUTTUU |
| 193 | UTGGTTGTGGAAGGAGRGAGUTUTURGTUUURGGGAGTATGUAAGTTUUUUTUUA<br>RGATUAUTTGAAAGGGATTGGGRGGAGTUTGTUATTTGGAGAAAAGGTUUTGGGA<br>GUTTAAGGTTTGTGTAGGGRGAGGARGGGGRGGTTUTGXGTURGGUUAGGTTGGUU<br>UTRGAGGAUUUAGURGTUUUUAAUUTUUTAAAUTGUTGTRGGATGTAGAAGAUTRG<br>UATTUAUTGUTUTUUAUAGTRGGTGAAGGGAGAARGURGAAAAGGGURGUATTUUU<br>TUUTGURGGTUUUUTUUUUT |
| 194 | AGGGGAGGGAUGGUAGGAGGGAATGRGGUUUTTTRGGRGTTUTUUUTTUAURG<br>AUTGTGGAGAGUAGTGAATGRGAGTUTTUTAUATURGAUAGUAGTTUAGGAGGTTG<br>GGGARGGUTGGGUTUTRGAGGGUUAAUUTGGURGGAXGUAGAAUGRGUUURGTUUT<br>RGUUUTAUAUAAAUUTGAAGUTUUUAGGAUUUTUTUUAAATGAUAGAAUTURG<br>UUUAAUTUUTTUUAAGTGATRGTUAGUUUAAAUUTGUATAUTUURGGGGARGGAG<br>AGUTRGUTUUTTUUAUAAUUAG |
| 195 | GGGTGTUAGGUTAUUUTTGAAGGGAUUUAUUTUUTUUAGUUAUTGUUAUTGGAUU<br>UTUUUTAGUUUUTUTAGUAAAGUAGUUUUAATGUATGUUUTGAGATTGUURGGA<br>AAAUTGUAUUAGAGGGAAGAUUTTTGGGUAUAGAGUURGTTATUTTATAAUAGUA<br>AGAUAUUGUAGGUTGUUTAAAUAUUUUARGAUAGAGAUGARGGAGUAATTUARGG |

| SEQ ID NO: | Sequence |
|---|---|
| | UAUUUUUTGUUAAGAGAGUAUUAUAUAGUUAUUAAAAAUGAUAAGUAGAGAURGG<br>TAGUGARGUUGAGUAAUGUUUUU |
| 196 | GAAAAUAUUAUUAGRGUAUAUAURGGUUUUGUUGAUAUUUUAAUGGUUGUGU<br>AAUAUUUUUUGGUAGGGGUGURGUGAAUUGUURGUAUUUUGURGUGGAGUGUU<br>UAGGUAGUUUGUAGUGUUUGUGUUAUAAAUAAXGGUUUUGUGUUUAAGAGUUUU<br>UUUUUGAGUGAUAGUUUURGGGAUAAUUUAGGAUAUGUAUUGGGGUUGUUU<br>GUUAGAGGGGUUGAGGGAGGGUUUAGUGGUAGUGGUUGGAGGAGGUAGGUUUUUU<br>UAAGGGUAGUUUGAUAUUU |
| 197 | GUUUAURGRGGAGGGUUUUUUUAUUUUUUUAUUUUAUGGUUAUUUAGGGUA<br>UUAUUAUUUUUUUAGGAAAUUUUUUUGUUUUUUUAUUUUUGGGUGUUUAUAUUU<br>UGGGUAUUUAUAGUUUAGAAUUUUAUUUGGGUUUUUUXGUUUUUUAGUGGUUGAGU<br>AGGAGUUUAGUUUUAGGAGAUUUUUUGAGUAGAAUGAUUUUUUUUUAUAUUUU<br>UAAUUUUUAUUUAUAUAUUUAGGAUUGGGUAURGGGGUUUGUUUUAAUUUGUAGG<br>UUUAGAGUUAGGGGUUAGGGUGG |
| 198 | UAUUUUAAUUUUUGAUUUUAAGUUUGUAAAUUUGGGGUAGGUUUUGGGUAUUUAGUU<br>UUGAGUGUGUGGGUGGGGUUUGGGAAGAUGAAGAGGGGGUGGGUUUGUUAGGGGA<br>GUUUUUAAAAUUGAAGUUUUAUUUAGUUAUUGGAAAXGGAGGGUUUGGAGGUG<br>GGGUUUUGGUUGUAGGUGUUUUAGGGUGUGAGAUAUUUAGAGAUAGGGGUAGGGA<br>GGGUUUUUUUGGAGGAGGUGGUGGUGUUUUUGGGUGAGUUAGUGAGGAUGAGGAGGAU<br>AGGGGGGUUUUURGRGGUGGGUA |
| 199 | UUUAAAUGAGAAGAAUAUGUUUUAUAURGUAUUUUGUGAAAGUUUGGUURGGAGUUA<br>RGRGUUGAUUAAUAUAUAGAUUUUUUUAUURGUUUURGUUAUAAUUUGUUAUAUUG<br>GUUGAUAAAUUURGAGGAAUUURGGUAAAGUUAGGXGGRGGRGGGGGUUURGGGUU<br>UGGGRGGRGGUURGGAGGAGUAGRGGGAGAUUURGUAGRGGUUUUUUUUUUUU<br>RGUURGRGGUUUUUUAGUUURGURGURGURGUURGGUUUUUAGUARGGAAURGARG<br>GGGRGUUUURGAGARGGGRGA |
| 200 | URGUURGUUURGGGAGRGUUURGUAGGUUURGUGUGGGAGURGGGRGGRGGRGGR<br>GAGGGUUGGGGGUURGRGGGRGGAGAAGGAGGAGGUGUGRGGGGUUUUURGUUGU<br>UUUUURGGAGURGURGUUUAGAUUURGGAGUUURGURGUXGUUUGGUUUUGURGGA<br>GUUUUURGGGAUUUGUUAGUUUAGAUGUGAUAAGAUUGUGGRGAGGRGAGUGAAGGA<br>GAUUUGAUAUUAAUUAGRGRGUAGUURGAGUURGAGUUUAAAUUUUAUAAAUGRGGUGUAG<br>AAAAUAUGUUUUUUUAUUUUUAAG |
| 201 | GUGGUAGGUUUGUGUGGAGAUUUGAAUUUUGUUUUUUUUUAGUUUUUUUAUUUAAGG<br>AUAUUUAGGAGAGUAAGGAUAUGGUUAGAGGGAGAGGUGGUGUUUUUUUUUUGAUU<br>GGGUUUUGUUUUUAGUUUUAUAGGUGAUURGGAAGAUUXGGGUGGAGUAGUUUUU<br>GAUGUUUURGGUAGUUGAAGUGUGGUGUUAGUUUUUUUAAUAUUUUUUAGUGAUUUA<br>GUUUUUGAUAUGGGUUAAGGAUAGRGUUUUAGUGGGRGAGGUGGGUAGGAGGAGGUAAG<br>UUAARGAUAUUAUUGUUAUU |
| 202 | GGUGGUAGUGGUGURGUUUGGUUUAUUUUUUGUUUAUUURGUUUAUUGGGRGUGAU<br>UUUUGGUUUAUGUUAAGAAUGAGUUAUUAAGAAUGUUGAAAAAUGGUAUUAUAGU<br>UUAAGGUAURGGGAGGUAUUAGGAAAUUGUUUUAUUXGAAUUUUURGGAUAUUUG<br>UGGGGUGAGAGUAGGGUUUUAGUUAAGAGGGGAAUAUUAUUUUUUUUUUUGUUUAU<br>AUUUUUUGUUUUUUUGGGUGUUUUUGGUGGAAAAGGUGGGAGAAAAUAGGAUUAA<br>GUUUUUAUAUAGAUUAUUAU |
| 203 | UGUUAUUUAUAUUURGUGGGUGAAAUAGAUAUUURGAGUAUGAUGAGUUAUUAA<br>GAGUUUUGRGGRGUUUUUUUGURGGGGGUUUAGAAAUUUUAAAGGAUGGGGGUUG<br>AGGGGAGGGAGGAGUUUAUGGGGAUAUGUGAUGUGGAUAGGGXGGGUAGGAGGAUGGAA<br>GUAAUAGGUUUAAAAUGUAUUUUGGUUGGUURGGUAGAGUUUUUGUAUGGGGUGAG<br>AAUGGUAAUUUAGGAAGAGUAAGUGUUUUUUAUUGUUGAAGUAGAAGAAAAAAGUGG<br>AUUUAAGGAGAAGUURGGGUG |
| 204 | UAUURGAAUUUUUUUUAAGUUUAUUUUUUUUUUUUUUUUUUUAUAGAUGGGAAGAUUU<br>GUUUUUUUUUAAAUUUAUUUAAUUUAUUUUAUUUUUAUGUAAGAGUUUUGURGGGUUAUUAAAG<br>AUAUAUUUUGGAUUUGUUAUUUUUAUUUUUUUUGUUXGUUUUGUUUUAUAUAUAUGU<br>UUAUAAUUUUUUUUUUUUUAAUUUUUUAUUUUUGAAAUUUUUUAAAUUUUURGGUAG<br>AGGAAGRGUUGUAGGGUUUUAAUAAGUUUAGUUAUGUURGAAAUAUUUGUUUUAU<br>UUAARGAGGUGUGGUAGGUA |
| 205 | GAGUUAAUUUUUUUUUUUAUUUUUGGAGGUGGGGGAUUGUUUUAUUUAGGUUU<br>GAAGAGGGUGUGUGUGAGUUUUUUAUUUGUGUGUGGGGUGAGUUURGGUUUUAUGUA<br>UAUAGUAUAUAUAUAUUAUAUAUUUAUUURGGAUAXGRGUUUAGGUUUUUAU<br>AUUGUUUUUAUAUAUUAUGRGUUUUUAUAUAUGUAUGUUUUUUUUGUAUAUAURGUU<br>UUUURGUAUARGUAUGUUUUUURGUAUARGUAUGUAUAUAGGGUUAUUUGUGUGU<br>UUGUUUUUGGUUGUGUGUGUU |
| 206 | AGUAUAUAGUAGUUAGGGAUAGGUAGUAGAGUGAGUUUGUGUGUAUGRGUGUGRG<br>AGGGGGUAUGRGUGUGRGAGGGGGRGUGUGUGUAAAGGGGAUAUGUAUGUGUGAGG |

| SEQ ID NO: | Sequence |
|---|---|
| | GGRGUATGTGTGTAAGGGUAGTGTGGGGAUUTGAGGRGXGTGTURGGGTGTGGGTG TGTGATGTGTGTAGTGTGTGUATGGGURGGGUTAUUUUAUAUAUAAGTGGAG AAUTUAUAUAUAGUUUTUTTUAGGUUTGAGATGAGGGRGGGUUUUUAUUUUAG GAATGAAAGGAGAGGTTGGUTU |
| 207 | UUUARGGGGUAGGUAURGGAGGGGGTGUUUAUAGAGGATAGAGGARGURGAGA AGTGAUUTGGGGAGUUAUAGGATGAGGAAGAGAAGAGATGAUAGUAGGGGUTG TAGGAGGUAUUUTUUARGGAGGGAGGGGTGARGGUAGAGGXGTURGUAGGAGUT GGTAURGGTGGGGUTGUUUUUAGGGGGGGUTGAUAGAGGUAGUAAUTGAGUAGGU AGGGGTGGAGRGAGGTGUUAGUUTGURGTGGAAAGGAGARGUUAGUAGRGGGGGG UUUTUUTGGGGUUUUAGTUUTGUTUT |
| 208 | AGAGUAGGAUTGGGAUUUUAGGAGGGUUUUURGUTGUTGGRGTUTUUTTUUARG GUAGGUTGGUAUUTRGUTUUAUUUUTGUUTGUTUTAGTTGUTGUUTUTGTUAGUUUU UUUTGGGGUAGUUUAURGGTAUUAGUTUUTGRGGAXGUUUTGURGTUAUUUU TUUUTURGTGGAGGGTGAUUTUUTAUAGUUUUTGUTGUAUTUTUUTUTUTUUTU AUUUTATGGUUUUUAGGTUAUUTUTRGGRGTUUUUTATUUUTGTGGGUAUUUUU TURGGTGUUTGUUUURGTGGG |
| 209 | TGAUAUTUAGGAUUUAAAAGUTAGUUUTGUUUAUUUUAGUUUUTUUAUUTUUTTA UUTGGGUGUGUAUUTGUTURGGGGGGTGGAGGTGUTUUUUAUAGTURGGGUUAGG AUAGUUTUAGGGGAGAGTGAAGGUUTGUAGGAGGGUAGGXGAGAUAAGGAGGGT GTUUAGGGUUAGGGAGTGURGGATGAAAUUAGUTUTGUUUUGTGUAGGUUUAG GUUURGUUTGAUAAAUAGGUAGGGAGUUAUAGUAGGGAUAATAAAAAUUUGGT GUAUUUGAAAGUAGUAUUTGGAUAG |
| 210 | TGTUUAAGTGUTGUTTTUAGAGTGUAUUAAGTTTTTATTGUUUTGAUTGTGGUT UTGUUTGUTTGTUAGGRGGGAGUUTGGAGUUTGUAUAGGGAUGAGUTGGTTTUAT URGGUAUUUUTTAGUUUTGGAUAUUUUUTTGUTUXGUUTGUUUTUUTGUAGGUUT TUAUTUUUUTGAGGUTGUUTGGUURGGAUTGTGGGAGUAUUUAUUUUURG GAGUAGGTGUAUAUUUAGGTAAGUAGGTUUAGGGGUTGGGTGGGUAGGGUTAGU TTTTGGAUUTGAGTGTUAU |
| 211 | UAAATAAGTAGTTAUUTAGAAGTUAUUTARGTAAAAGAUUAUUUUUAAAARGU UAGGUAUAUGGAUUAUAUTGTGTTAUUAARGARGAUAUAATGGUAUAGAAUGTA UAUAUTGAGAAGTGAGTGUUUUTURGGGAUAAUTXGUAGTGAGUAUUAGU AUTAGAAUAUTGGAGAUAAATAAAUAUUUAAUUTUTTUTAAAAUAGTUTGAAATTU AAGTGGUAAAUUAGAGUAUAUGGURGGGUATGGUGGUUAUGUUGTAAUUU UAGUAUGAGGUGAGATGGG |
| 212 | UUAUUAGUUUAUGUGGGGUUAUAGGUAGAGUUAUUAUGUURGGUAUGATG UTUAGGUUAUGAUUAUUTGAATTUAGAUGUTTUAGAAGAGGTGGTATUUATTTAT ATUTUAGTGUTUTAGTGUTGAUAUTGAXGAGUATGUUARGGAGAGGGA UUAUTUUAGTATGAUAUA1TUTGTGUUATUGTAUGTRGUGAAUAAUAUAGTG AUAAUUATGGUTGGRGUTTGGGGATGAGUUTTTARGUAAGTGAUUUTGAG GTAAUUTAUUUUTATGA |
| 213 | GTUUUAUAUTTGAUUGGGAUAAAUUUTUUAAAUAUUTATAGAUUUGGUTUUU TRGUUAAUAAGUAGUUAUAUAUAUTAGTGUTUAGUATAGUAUGAUGAUGGUUAU UURGAGGUUAGGATGAUUAGUAGGGGATUGAGUTGXGGGRGTUAUGUUAAGGU URGGAAUAGAGUUUGGTGUTUAUUUUTAUAATAGGTGGGUAAAUUUAGGGUAGG GAGGGGGGUAATGUUUAGAGAAUGGUTUUUUAUUUGGGGRGGUUGARGGGUUAGAG ATGUAGAGAAGAGARGUUT |
| 214 | AGGRGTUTUTTTUTUTGUAUUTGGURGTUAGAURGUUUUAGGGUGGGAUUATU TUTGGUATUGUUUUUUUTUUUUGUUUTAGGAUUGUUUAUTAGTGAGGAATGAG UAUUAAUUTUUTATTURGGGUUTGGAGUATGARGUUUXGUAAAUUAATUUUUGUT GAGUUAUUTGAUUTRGGGGTGGGUUAGUAUTGUAUTGUTGAGAUATATATGT GTGAGUTGUTTGTTAARGAGAAAGUAAGTUTGUAAAATATTGAAGAGGTTTAUU RGGAGUAAATGTGAGGAU |
| 215 | GAAAGUAGUUTUTUUUGUUUTGTAAGGUGAUUURGAUURGGGAAUUUUAUTUT UTGAAGGARGTTUTGGAAAAGUGUAAAGAUUAAUTGAGATUUUUTGUTTUTGGAUA AGUAUUUUTGAUAUUATXGUUGAUTTTUTAAAAAAGAUUGUGUAAAAUTA UUUXGTGAGAUAGAAAATGUAGUAGGGATGAAUAAURGGUUUUUUAGAUUUTA UUAGUUUUUAGGUAUUUUTAAGAGUUUAUUUUTURGUTUTGTTGGUAGTGGGGG AGGUARGGGGURGGATGGUA |
| 216 | TGUUATURGGUUURGTAUUUUUUUUAUTGUUAAUAGAARGGAGGAGTGAGGUTUT TAGGAATGGUUTGGAGGUTGGUUGAGGUUTGAGAGGGURGGTGAUUUUAUUUGTGUG UAUUUUGATUUAUXGAGGUAGATUTGGUUAUAAAUTUTUTTTTTAGAAAATRGGA AXGATAGTGUAGGAGTGUTrGAUUUAGAAGUAGGAAUTUAGUUAAUTGUGUAU TTUUUAGAARGUUUUAGAGAGTGGGAATUUGGGATRGGGATUAUUUTAUAGG GUAGGGAGAGGGUTGUTTU |

-continued

| SEQ ID NO: | Sequence |
|---|---|
| 217 | AAGAAAAGAGAAAGUUUAUUUAGGUAAGGGUAGUUUGGUGAUUAUUAUUUGGGGAGAUUU<br>UUUAUUUAUAUUGUUAUUUUAGGUUAUUURGAGGGUGUAGUUUUUURGGAUGGAUUUAG<br>GGXGGUUAUUGGUUUUAGAGUUGGGGGUGAGUGGGUURGUGUXGAGGGUUGUUGGXGUUUG<br>AUAAGURGGUUUUUAUUGUGAGUAGGGAAGGGRGGAUGGGRGGGGGUUARGGUUGUUUGG<br>UUUUUUAUUUUGUGUGUUUUUUUUAUUUUUUGUUUGUUUUUAAUAUUUUAGU |
| 218 | AUUGGGUGUUAGGAGGUAGGGUAGGGGAGUAGAGAGAAGUAUAGUAGGGUGGGGAGUUAG<br>GGUAGURGUGGUUUUURGUUUUAUURGUUUUUUUUUGUUAUAGUGGGAGURGGUUUGUUAGA<br>XGUUAUAGUUUUXGGUARGGGUUUUAUUUAGUUUUUUAGUUUUGGGAUUAGUAGUXGUUUUG<br>GAUUUAUURGGAGGAAGUUGUAGUUUUGGGGUGAGUUUGGAGUUGGUAGUGUGGGUGGGAG<br>UUUUUUAGGGUAAUAGUUAUUAGGUUGUUUUAUUUGGAUGGGUUUUUUUUUUUUUIT |
| 219 | UUGAGGUAGGGUUGUAGGUUAGGAGGAGGAGAUGGGUGGAGAGAAUAAGUUUU<br>AUUURGGGAGGGUGAUUAUAGGAGAAAAUGGGUUUUUUAAGUUAUGUUGAUUUUXGU<br>UUUAUUGUGUUGUUGUUUUUXGUUUUAUUUURGGUUUGGUUUAUUUGUUUUUGUAAG<br>UAGGGUUUUGGGUUGGGGUGUUGUAGGXGUAUGAGGAAAAGUGGGGAGURGGGARGGG<br>GUAGUUUAGGGUARGUUUUUAAUAUUGUGUUURGAGGAUUUUAGRGGUUUUUAUUU<br>AGGGGGUGUUAUUGAGGUAUAGU |
| 220 | GUUGUGUUUAGUGGUAUUUUUGAGUAAAAAURGUUGAGGUUUUUGGAGRGUAGUGU<br>UGGAGGGRGUGUUUUGAGUUGUUUURGUUURGGUUUUUUAUUUUUUUUUAUGXGUUUGU<br>AGUAUUUAGUUUAGGAUUUUGUUUAUAAGAGUAGAUGAGUUAGAGURGGAGGUGG<br>GXGGAAGAGUAGGUAGUAGUGAGGXGGAAAAUUAGUAUAUUUGAGGGGGUUUAUUUU<br>UUUUUGUAGUUAUUUUUUURGGGGUUGAGUUUGUUUUUUUUUAUUUAUUUUUUUUUU<br>GAGUUUUGUAGUUUUUGUUUUAG |
| 221 | GUUUAGGUUGGAGUGUAGUGGRGUGAUUUUGGUUAUUGUAAUUUUUGUUUUGUUURGG<br>GUUUAAGRGAUUUUUUUTTGUUUUAGUUUUUAGAUAUUUGGGAUUAUAGGGUGUUGUGA<br>UAUUAUAUUUAGUUAAUUUUUUGUAUUUUUAGUAGAGAXGGUUAUGUUAGUUUAGGGUUG<br>GUUUUGAAUUUUUGAUUUUAGUGAUUUAURGGUUUUAGUUUUUUAAAGUGUGGUAU<br>UAUAGUUAUGAGUUAUUGUAUUURGGUUUUGUGUUUUUGUUUUUUUUAGUGGGUAUUUUAU<br>UGUUUUGUUUUUUAAUAUU |
| 222 | AAUGUUGAAAGUAAGGUAGUGGGAUGUUAUUAAGGAAGUAAAAGUAGAGGURGGG<br>UGUAGUGGUUUAUGAUUAUAAAUAUUUAGUAUUUUGGGGGUUUGAGGURGGUUGAAUUAU<br>UGAGGUUAGGAGUUUAAGAUUUAGUUUGAUUAAUAUGGUXGUUUUUAUUAAAAAUAU<br>AAAAAUUAGUUGGGUAUGGUUGUUAUAUAUAUUUUGUAAUUUUAGGUAUUUGGGAGGUUG<br>AGGUAGGAGAAUARGUUUGAAUURGGGAGGUAGAGGUUUGUAGUGAGUUAAGAUUAR<br>GUUUUAUUGUAUUUUAGUUUGGGU |
| 223 | GUUUAUUUUAUAAAAAUGAAGAGUAGAGUURGAGUGUUUAUAAUAARGUUAUUUUUUAU<br>UUAAGAUAGAGAAGAAAAARGAAAGAGAGUUUGAGUAUUUUUUUUGAUUUUUUUUA<br>UUUUURGGAAGGUAUAUUUAGAGUUUUUAAGAUUGUUUUXGUUUUAUUUAUAUGUUTrA<br>UGGUURGGUGAGAUURGUAUUUUUUUUUUUUUAUAUUUGUUUUUUUUUUGGAUGUAGGG<br>AUAUAGAAUUUUUUAAGUGGGAAGAGUUUGGAGUUGGAGGUGUUUAAAGUUUUGU<br>GGUGAUUAAUUAUUAUUUAU |
| 224 | UAGGUAAUAAUUAAUUAUUAUAGAAUUUGAAUAGUUUUUAUUUUUAAAGUUUUUUUU<br>UAUUUAGGGGAUUUUGUGUUUUGUAUUUAGAAAAGGGAUAGAUAUAGAAAGGGAG<br>GAUGRGGUUUUUAURGGGUUUAUAAAUAUGUGAGUGGGXGGAGGUAGUUUUGGAGAUU<br>UUGAAUAUAUUUURGGGGGUGGAGGGAGUUAAAGGAAUGUUAGGUUUUUUUUURG<br>UUUUUUUUUUUUUGUGUUUGGGUAAAAAUGARGUGUUAUAAGUAUURGAGUUUUGUUUUU<br>UAUUUUUAUAGAGUGGUU |
| 225 | AUUAAAAAUAGUAAAAUUUUAGGUUUUAAAGUAGGUUUUAGUGUUUAUUAAGAUAAUAA<br>AAGGUUUUAAAUGUUAGGUUUGGGRGUAAAAUGUGUAGAUAAGRGGGUGGURGGA<br>GAAGGAGGGGGUUAAGGAAGAGAGGGAAAUUUAAUUUGAXGGUUAUUUUUUUUUUA<br>GAGUUAUUUURGGUGGGUUUGUUUUUAUUUUUAAUAAAAUUUUGUUGUUUUUGA<br>UUUAGGUAUAAAAAGUGAGGUUUUGGAGGGUUUUUGAGAUUAGRGUUUGUAUAG<br>UGAUAUGGUAUAGUGAUAUGG |
| 226 | UUAUGUUAUUGUGUUAUGUUAUUGUGUUAGGARGUUGGGUUUAGGGGUUUUUUAUUG<br>UUUUAUUUUUUAUGUUUGGAAUGUUUAGAGUAAUAAAAUUrGUUGAGGGGUUGGGGG<br>UAGAUUUAUURGGAAAUAAUUUGUAAAAAAAGUAAUXGUAAUUGAGUUUUUUUUU<br>UUUUUUUGAUUUUUUUUUUUUUURGGUUAUURGUUUGUUGUAUAGUUUGRG<br>GGUUGGUAUUUAGGAUUUUUGUUAUUUUAAUAGAGAUUGAAAUUUAUUUGGGUU<br>UGGAGUUUGUUGUUUUAAU |
| 227 | GGUUUUGAGAGUUGUUGGAAUUAAURGGARGGGGUUAGUUUUAUUAUGGGAUUUGG<br>URGAUGAGUUAUUUUUUUGAAGGRGUUUUUUUUUGUGAAGUGGGGAAGGUAAUU<br>GUUAUUUUAUAGGGRGAUUGUGGGUAUURGGGAGAUUXGUUGAGGGAUGUUGUAG<br>UGUAGAAGUUUUUAAAUUUARGUUGUUUUUUUUUUUUUUUAGUUUUUUUURGUUGU<br>UGUUUUURGGUUUAUGUUUUGUGGUUGAUUUAUUAURGGUUUUUUAARGGUUUUUAU<br>UUUGGGRGGGUUGGAUGGUUG |

-continued

| SEQ ID NO: | Sequence |
|---|---|
| 228 | AGUUAUUAAUURGUUUAAGGTGAAGGURGTGGAGAGURGGTGATGGAUAGUUA<br>UAGGGUAUGAAURGGAGGGUAGUAGRGGGAGAGGAUUGAGGAGGAAGAGAAGUA<br>GRGUAGAUUUGGAAGUUUUAUAUUGUAGUAUUUUUAGXGGGUUUUURGGGUGU<br>UUAUAAURGUUUGUGGGAUGAUAGUUAUUUUUUUAUUUAUAGAAGGGAAGARG<br>UUUAGAGAGAUGAUUAURGGUUAGGUUUUAUGGUGGGGUUGAUUURGUURGGU<br>UGGUUUAGUAUUUUAGAGUUU |
| 229 | GURGURGUUUUUUUAGUUUUGUUUAAUURGGUAUUUUUGRGUUUGUUUAGUUAUUR<br>GUAGGAGRGUAGGURGUUUUUURGUUUUUURGUUUUUUGRGUUUAUAGGAUUURGG<br>GUUURGUUUAGUURGUAGGUUURGUAGGUUUUUURGGGXGUGUUUUUUGGUUUUG<br>RGAUUUURGGGAUAGRGUUGAGAAUARGRGGAAGGUGGGGAGARGRGRGGRGUUG<br>GURGGGUUUUGGRGURGUUUURGRGGUGUAGUUUGUGUUUGGGAGUURGGURGUU<br>UUAUUUAGAAUUAGAGUAAA |
| 230 | TTTGUUTUUGGUUUUGAGGUGGGARGGURGGAUUUUUAGGUAUAGGUUGUAURGRGA<br>GAARGGRGUUAGGGAUUGGUUUAGRGURGRGRGUUTUUUUAUUUURGRGUUGUUUUT<br>UAGRGUUGUUURGGGGGUUGUAGGGUUUAGGAAGAUAXGUUURGGGGGGAUUUGRGG<br>GAUUUGRGGAUUGGGRGGGGUURGGGGUUUUGUGGGRGUAGAGGARGGAGGARG<br>AAGGGRGGUUUUGRGUUUUUGRGGGUGGUUGAGGUAAGRGUAGAAAUARGGGUUG<br>GGUAAGAUUGGAAAAGRGGRGGU |
| 231 | UUUGGGAUAGGUUUAAUGGAGGUUGUAGGGGUUAUAGURGAUUUUUAGRGUAGGUU<br>UAGUUAGUAGUUUUUGGUUAGUUUUAUUUUUGAUUGURGGUUUAGAAUUGGGA<br>GUUGUUUUUGGUAGGGUURGUUUUGUUGGGAGAURGGAXGGUGAGUUAGUUUTA<br>AGUURGGUAUUAGAUUUUUUUGAGGAUGGAGUAUUAGUUGGUUGUUUUGAGGUUG<br>UAAAAUUUUUUUURGUGGAGAUAGGGAGGUAUUAGAUAUUUAUUURGGAUU<br>UUUUUGAAUAGGGAUAGGGAGGAA |
| 232 | TTUUTUUUTGUUUUTGUUUAAGGGAGUURGGGGUGAGUGUUGAGGUGUUUUUUGU<br>UUUUAGAGGGAAGAAGUUUUGUAGUUUAGGGUAGUUAGUUUUUGUUUUAUUUU<br>AGAGGGGUUGUGGUGURGGGUUAAGGUGAUUUAUXGUURGGUUUUUUUAGUAGAGG<br>RGGGUUUUGUUAGGAAGUAGUUUUUAGUUUUGAGGURGGUAGUUAGGGGUGGGGU<br>UGGUUAGGGGGUUGUGAUUGAGUUUGRGUAGGAGUUGGGUUGAUGGUUUUGUAGUU<br>UUUAUUGAGUUUGUUUUAGG |
| 233 | AUAUUGUGGGGUAGGGAGGGGUAUUUUUGAGAAUAAAAGAUUUAUUUUUTRGAUUU<br>UUUAAAUUGGAGAGUUUUUGAGAGAAAAGAGAGAGAUAGGUAUAGGUUUAARGUU<br>AUUUAUAUAUAGUUUUGUGUAUAUAGAURGGAUAUAGGXGUUUAUAGGUAAGUUR<br>GUAGUUGUUUAUUUUGUGAAGUGAAUGUUGAUUUGGGGGURGGGUGGGGUUUGUUUG<br>TAUAURGUGUAUUGUUAGAUUUUUUUGAAGGAUUUUUUGUUAUUGAAGUAUAGAAG<br>GUUUUUGUUUUAAGGUGGUG |
| 234 | AUUUAUUUUAGAAUAAGGGGUUUUGAUAUUUAGUAAUAAAAUUUUUAGGAAGG<br>GUUUGAUAGUUGUUARGAUGUAUAGARGAAUUUUAUURGGUUUUUUAAAUUAGUAUUU<br>AUUUAUAAAAUGAGUAGUUGRGAAUUUGUUUGUGGAXGUUUGUGUURGGUUUGUUG<br>UGUAUAGGGUUGUGUGGGUGGRGUUGGAUUUGUAUUGUUUUUUUUUUUTUTUUA<br>AGAAGUUUUUAGUUUGGAAAGUUGAGAAAUGGAUUUUUUGUUUUAAGAGAUGUU<br>UUUUUUGUUUUAUAGUGUG |
| 235 | AUUUAGGGGAUAGGGUUAGAGUAAUGGAGUGGAAAUGGUAGGUUAUAAUUUG<br>GUUAUAGUUGUUUUUAUUUUAAGUAAUUUAGGUURGGGUUGGAGGGUGGRGAUU<br>UUAAGAUGRGGUUUUAGURGURGGUXGUGUUUGUGUUUUAGUXGAUGAAGXGAGUG<br>UAAAGGGUUGUAUAAARGRGAGGUAUUGAAUAAAUAUUGAGRGUGURGUUUAGAUT<br>GUUURGGGGGAGGUUGAGGAUUUAUAURGUGGGGAGUGUUUGUUUUUAUGGAGUT<br>GAUUUGGRGUURGUUUUUUUARG |
| 236 | RGUGGAGGGRGGARGUUUAGGUUAUUUUAUGGGGGUUAGAGUUAUUUUUUARGGUGUUG<br>GAUUUUAGUUUUUUURGGGAUAUUGGARGGUARGUUUAGUUGUUUGUUUUAGUGUU<br>URGRGUUUGUAUAGUUUUUUUGUAUUXGUUUUAUXGGUUGGAGUAUAAAUAXGGURG<br>GRGGUUGAGGURGUAUUUGGGUTRGUUUAUUUUUAAUURGGAGUUUGGGUUGUUT<br>AGAGAUGGGAGUAGUUGUAGUUAAAAUUGUGAAUUUGUUAUUUUAUAUUUAUUUAUT<br>UUGAUUUUUGUUUURGUGGGT |
| 237 | RGAGGUGRGGUUGUUUURGRGGUUUUUUURGGUUUUURGUUURGRGUUGUUUUUUGGGA<br>GUUUUUUUUUURGGAGGUUUUUUUGUUUUUAARGUGUGUUUUUUUUUUAUGUUUAGUA<br>TTRGGGRGUUUUUGUUUUUUUUGUUUUUGGGUUUUXGGRGUUUURGGGAGUGUGA<br>UUUURGUAGRGGGGUGUAGUUUUUUUUGGGAUGAGUGAURGGAGGGAAUUUGUUUT<br>UUURGGGUAARGURGUUUAGUUUUUUUUUUUUUUUUUUAGGUUAUAAGRGGAUUUAT<br>GAUAAGAAGGRGGTGGAT |
| 238 | AUUUAURGUUUUUUUGUUAUAAGUURGUUUGAUAGUUUAGGGAAGAAGAGGAAGAG<br>GUUGGRGARGUUGUURGGGAAGGRGGGGUUUUUURGGGUAUUUAUUUUAGAGGAAA<br>GUUGUAUUUURGUUGRGGGAGUUAUAUUUURGGGGARGUXGAAGUUAGGGAAUAGA<br>AGAAAGAUAAGAGGRGGUUURGAAUGUUGGAUAUGGAGAAGGGUAUAGRGUGGAGGUA |

| SEQ ID NO: | Sequence |
|---|---|
| | GGAGGGUUTURGGAAGGAGGGAUTUUAGGAAAGUARGRGGGARGGGAAGURGAGG<br>AAGURGRGGGUAGURGUAUUTRG |
| 239 | TGUAGTGTGTAUAGGAUTUUUTGAAAGGGUTUUUTGGGATGGAGGGTTTTTTGGGGG<br>GGUUTGTGGTTUTTUTUUAGUATGAGUAUAAAUUAUAUUUUUAUAGUUAGURGG<br>AUUAAAURGATTTGAURGAGATXGGUTUTTUAATGXGGUTUUURGGGGTGUUUR<br>GAGGAUTUGGTUGGAUUUAGAGUAUGUAGUAAGAUUAGUAAGUAUUAURG<br>AUTRGGAAUAUAAGGUAGAUUUTGUUUTGUGGAUUAAGGUAGGUAUUUGUGA<br>GUTGAUAGTAGGTGGGUTGT |
| 240 | UAGUUUAUUUAAUUAUAGUUAUAGGAUGUUAGUUGGAUUAUAGGGUAGG<br>GUUUAUUUGUGUAUUURGAGUUGGUGAGGUAUUUGUGGUUUUGUUAGGUAUUTUG<br>GAAGUUUAGUUAGAUUGGGGAUAUUGGAGAUXGUAUGAAGAGUXGAUU<br>TRGGUAAATRGGUUUTGGATURGGUTGAUGUGGAGGAUGUGGUUUGUGAUUAUGU<br>TGGAGAAGAAUAUAGGUUUUUUUAAAAGUUUUAUUUAUGGGGAGUUUUTUAG<br>GGAGUUUGUAUAUAUGUAU |
| 241 | AGGAGUUUGUGAUUUAGAAAUGGUAAGUAAGGUUGATTUTAUUAAUAAAGAUAG<br>GUAUGAUUAGAUAAGUUUUAUUUGUGUUGGGUUUAGUUUUUUUUAGUGA<br>GGAGGUGGGUGAGGGGUUUGUUUUUUURGGGAAUGGXGATTUGGGAAGGUAGAG<br>AUAUUUAGAAUXGURGGAGUUUGAAAAUUAUUARGUUUUUUGUUUAGUAAT<br>UUTGAGAAAGGUAUAUUUGAUAGUUTGUGGUGGGUAGAUGAUAGUAUUUUGGG<br>UUUAGAGARGAAGUGGGAGGG |
| 242 | UUUUUUUAUUUGRGUTUGAGGUUUAAGAAUGUGUAUUGGUUAUUUAUAGUUUTA<br>TUAGTGUGUUTUTUAGGAUGUUGGGAUAAAGGGRGUGGGUGTTTUAGGGAUUU<br>RGGXGGAUUUUGGGAAUGUUTUGUUUUUUAAAUGUUUAGUUUURGGAGGAGGAU<br>AGGAUUUUAUUUUUAUUAAGGAGAAAUGAGGUUUAGAGUAGGGUAG<br>GGAUUGUUGAGGUUAUGUUGUUUGGUGAGAAURGGAUUUAUUUAAUUAUU<br>TUGGGUAUAGGUUUUT |
| 243 | AGUUUGGUGAGUGUUUUUAUUUUGGURGAGUUUUUAUGAAAAAAAUUU<br>GGUGAUUUUUUUGUAUAGAAUAAAGGUUGAGUAGGGUAUAGUGUUUAGGGGAUG<br>AGGAAGGUUGAGUURGGAUUUAGGUAGGAGGAAUUUGUXGUGUAUUUAUUUAGAU<br>TUUGUAGAUAUURGGGGAGGUGUUUAUUAGRGGGUAUAGURGUUUAGURGUUU<br>UUUAUUURGURGUAGUUAGGAUUAUUAUAGUGUUAGAGAGGUUUAUUAUUU<br>GGUUAURGGGUUAURGUGUAGA |
| 244 | TUTGUAGGRGTAGAUURGGUGGUAAGTGGUGGGUUUUTUTGAUAGUGUGGUGAT<br>UUAUTGGUGRGGRGGATGAGGGAGGGAGGRGGUUGAGRGGUGUGUURGUGGUGGAG<br>UAUUGUUURGGGUGUGUAGGAGUUGAGUGAGUGUAXGGUAGGUUUTUUUGUU<br>TGGUUURGGGUUAGUUUUUUAUUUUGGGUAUGUGUUUAUUAGUUUUTG<br>TTUGUGUAGGAGGAGUAUUAUUUUUUUUUAGGGAAUURGAGUUAGGGAAGU<br>GGGGGGUAUUAGUUAGGGUT |
| 245 | UTUTGGGUUTUTUUAUAGGGUUGAGGUUAGAGUAUUUAGAAUUURGURGGAG<br>GGGUUTUGUUGGAGGAGGGUAUAARGAUAUUAUUGUUUUAUUAGUUGAUTG<br>AGGGUGGGGUTGGGUGGGUUAAUAUAGUUAGUGUUXGUUUAAGAGAUGUUUUR<br>GGAAUAGUGAGUUAUUGGGUUAGGGGGUUAUUUGUGAGAGGAGGAGGUGAGU<br>GGGGUGGGGAGUAGGGUUUUAUUUUTUTUTUUAAGUUAAGGGUUTTTTUUTGGGTG<br>GGUUGGGGUUAUAUUTAGGGUU |
| 246 | GUUUUAGGUGUGGUUUUAGUUUAUUUAGGAAAAAGUUUTAGUUGGAGAGGAGG<br>GUGGGGUUUGUUUUUAUUUUAUUAUUUUUUTUUAUAGUGGAUUUUTG<br>GUUUAGGUGAUUAGUTAUUURGGGAAUAUUUUTAGAGXGAGUAUGAAUTGUGT<br>GAUUUAGUUUAAUUUUAGUUUGGGUUAGUGAUGGGGAUAAGUAAGUGURGTTG<br>TGUUUUTUUUTUUAGGUAAGGUUUTURGGGRGGGATUUTGAGAAUAGUTGGUUTUA<br>AUUUTGUGGAGAGAGUUUAGAGU |
| 247 | RGUUUUGGUUTUGGGUUTUUAUUAURGUUUGGGGUUUTGUTUGGAUTUTGUAGUTG<br>TGUUUUAAGGUUGRGUUUTAGAUUTGUUUAUUUUTUUUTUUUUUUTGUTTU<br>UUUURGGUUUTGUTAGUTUUUGUUUTUUUAUUTAXGUGGUUGUUTGGGUUUUA<br>TGUAGUUUUUUURGGGAUGUUUUTATGUUUGUUGUTGAUUGUTUATUUTUGAU<br>UAUUUUGAUGGUUGUUUUAGUGUAGGUAGAAUUUUAAAGUUUUTGUUUTUAU<br>AUGUUUUTUTTGUUUAUU |
| 248 | GGTGGUAAGGGGAUAUGUAGAGAAUAGAGGAUUTGGGGUTUUGUUGUAUTG<br>GAGUAGUUAUAGAGGUGAUUAAGAGUAAGGUAGUAUAGAAUAGAGUAUGGGGU<br>AUUURGGGGGGAGGAGUGUAUGGGUUUAAGGUAGUUAXGTAGGUGGAGGAGUAG<br>GAAGAUUAUAGAGGURGGGAGAAAGUAGGGAGGGGGUAGGGGAAGGAGUAGAUA<br>AAUUTAGGGRGUAGUUTGGGAUAUAGUTUGUAGAGUTUAAGUAGGGUUUUAGGRG<br>GUGGUGAAAGUUUAGAGUUAGGGRG |
| 249 | TTTUUTUUUTUTUTTUUTTUUTTUTUUAGUUUTUUUUUUTTUUTUUTTUAUTGTTUGA<br>TTTTAGUUUTUTGATTTTTTUUTTUUTTUUTUTUUAUTUTTTATTUTTTTTUAUUTUT |

| SEQ ID NO: | Sequence |
|---|---|
| | UURGGTUUTTTTTTUTGUTTTGTUAUUTUUTTXGTTTTUTTUTUTUTGGUTGAUTU<br>AGGGGAURGGAGGTGGGUUTATUTGGAGTGAGTGAGTAAGTGTGTTGGGAGGTGAG<br>GGTGGAGGGUTGGAGGGGGGUAGTGAUTGGUUTGAGUUUUUUAGTAUTGUTUUA<br>GUUUUAGURGUAG |
| 250 | UTGRGGUTGGGGUTGGAGUAAUAUGGAGGGGUUAGGUUAGAUAUGUUUUUU<br>UUAGUUUUUAUUUUAUUUUUAAUAUAUUAUUAUUAUUAUUUAGAUAGGUU<br>UAUUUAGGUUUUUGAGUUAGUAGAGAGAGAAGAAAAXGAAGGAGGUGAUAAA<br>GUAGAAAAAGGAUGGGAGGAGGAUGAAAAGAAAAUAAAGAGUGAGAAGAGGA<br>AGAAAAAAUAGAGGGUUAAAAAUUAAAUAGUGAAGGAGGAAAAGGGAGGAAUUG<br>GAGAAGGAAGGAAAGAGAGGAGGAAA |
| 251 | UTATAUTUTUAGGUUUAGGUUAGGGRGGUAGUTGUUUUUUUAUUGUUUUARGU<br>AUAAAUUUUUGGUUUUAGUUUAAAAUGUAUAUUGUGAGUUUAGAUTGGGUGGGGU<br>URGGAGUUUUUAUUAGUAUUAGGUGGGAUGGUUTGXGAAGAUAAAGUUTGUU<br>UGGUUUUUAGUUUAGGGUUGUAGUUUGGGGUUUUGUUUUAGGUAGUUUGUUUAGGAU<br>GUGUGUUUAGUUUUUGAUUUUGUUUAUGUAGUUAGAUGGGGUUAUUGUGAGU<br>UGGUUUUUUUUUUUAGAAUGA |
| 252 | TUAUUUAAGGAGAAAAGGUUAGUUUUAUAGAUGGUUUUAUUGGUUGUAGUGGG<br>UAAAGGUUAGAAAAUGGUAUAGUAUUUGGGUAGGUGUUUGGGGUAGGGUUUGG<br>GGUUAUAGUUGGGUGGGGUUAGAUAGAGUUTAUUUXGUAAGGUUAUUUAU<br>UGGUUGUAAUGAGGAGGUUAGGGUUUUAUUUAGAUGUGAGUUAUAGUAGRG<br>GUUUGGAUGAAAUUAGGGAUUUGUGRGUGGGGUAGUAGGGGGGUAGUUGURGUU<br>UUUGGUUUGGGUUGAGAGUAUAG |
| 253 | ARGGGUGUTGUUUUUAAGUUGGGUAUUUUUUUUUUUAGGUUGUGGGAAUGUUGG<br>GUUAUUUGAUUUGAAUUAGAAAAUAGUUUGAUUUUUUUUUUUUUURGRGUUU<br>UUAGUGGAUGUUUUURGGGAUUUAGUUAAAUUAUAGXGUURGGUAUAGGGU<br>UUUUUUUUAUUGUAUAAAUGUAGGGAGAUAGAGAGGAUGGGGGUUURGGGAU<br>UAUGUGGGGUGRUUAGAUTAUGGGGARGUAGGGGRGUAGUUAUUUGUUGGAGAUA<br>GGUURGUUUUAUGGUGAGTU |
| 254 | GAUUAGUUAGUGAGGAGRGGGUUUGUUUUAAUAGGUGAGUUARGUUUUARGT<br>UUUUUAUAGTUGGRGAUUUAGUAUGUUUGGGAUUUUUAUUUUUUGTUTUUUU<br>UAGRGGUUGUGUAAUAAGGGAGAGGUUUUAUGURGGAXGUGUGGUUUGGUUGGGG<br>UUURGGGGGGRGGUURGGUGGGGGRGRGGGGAGAAAGAGGGGGGUUGGGGGUUAU<br>UUUGGUUUAGGGUUAGAAUGGUUUAGRGGUUUUUUAUAGUUUGGGGAGGGGUGUU<br>UAGUUUGGGAGUAGAUAUURGT |
| 255 | GUAGUAAAUAGUUUUAUUGUAUAAAUAUAUAGRGRGGGUUGGGRGGGGGRGGUUAA<br>UUURGGUUUUUGGUARGGGGAUAGGGRGRGUUGGGUURGGUUUUGUAGRGAGUR<br>GGUGGGAGGGUUUAGUUGUGUUUAGGRGGUGUUGAGUAXGGGURGGGGGRGUUA<br>UAGURGGGAGGGURGGGUAGRGAGRGGGUUGGGRGAGGGGRGAGUAURGGUTGUU<br>UURGUURGAGGGGAUUURGGRGRGGUGAGGGARGUGGGUGGAGGGAGARGUGGGG<br>AGUUAGUUGGAGUAGAUGAUGAA |
| 256 | TTUAUUAUUUAUUTURGAUUGAGUUUUUUARGUTUUUUUUAUUUAARGUUUUUAUU<br>RGURGGGUUUUUUTURGGGRGGGGUAGARGAUGAUTRGUUUUUTRGUUUAUURGUT<br>RGUUGUURGGUUUUUUURGGUUAUGARGUUUURGGUUXGUGUUUAAUAURGUUTG<br>GGUUAUAGUUAGGUUUUUUUAURGGUURGUUGUAGAGURGGGUUURGRGUUUUT<br>GUUUURGUGUUAGGGAAURGGGGUUGAURGUUUURGUUUAGUURGRGUUAUAUAUU<br>UGUAUAAUAGGAUGUUUAUUGU |
| 257 | AGTAUTUUAAUAUAUGGUUUUUAGUGGGUAUUAALUGTAUAAGUUUAUGUUUTU<br>UAUUUUAUAAAAAUGGAGAUUAUAAUUAUAUUGUUGUAAAAUUAAAAUUAGAGGT<br>TUUAUAGRGUGAUGAUAUGUGUUUURGGAGAGUUUUXGGUUUUTUUTGGUUTGG<br>GUUUUUTGGAAUARGGTGAUGUUUAGUUUAAAUAGUGUUAUAUUUGUUTAUAAT<br>GUUUUAARGAGAGUAUAUAUAUUAAAGAUUUUTGAGUUAGAGGGAUAAUAGAGGAGGGT<br>GGGAAUGGGUAAAXGGAGAGT |
| 258 | UTUUTUXGTTUAUUUAGUUUUUAUUUUUUUAUUGUUUUTGAUUAAAAAUUUUTGG<br>UUGUGAUUUTRGTUGAGGUAUUGUAGAGUAGGGUGUGGUAUGUUTGGGUUGGGUAU<br>UARGUGUUUUAGGGGGUUAGAGUUAGGAGAGGGUXGAAAUUUUTURGGGGUAUAGT<br>GUTRGGUUARGUGUUAGAAAUUUTTGAAUUUTTGGATTTUGUAGUAGGUAUGAUUGUGG<br>TUTUUAUUTUAUGGAUGGAGAAUAUGAGGUUAGUGAUAGGUUAGGUUAGUGUUAUUGGGG<br>UUAUGUAUUAAAUAAUUG |
| 259 | GAGUUUXGUUUUTUUTUUTGGUTUTGGUUUUUUUGGAAUARGTGAUGUUUAGUUUAAA<br>UAGUGUUAUAUUUTGUUTUAUAAUGUUUAAAGAGAGUUAUAAUUAAAGAUUUUTG<br>AGUUAGAGGAUAAUAGAGGAGGGTGGGAAUGGGUAAAXGGAGAGUUUAUGGUUTT<br>TGGAGGUGGGGGUAUAGUUGGGAGUGAAUGAGGGGUUUAGAGUUUUUAGAGAAURGA<br>AUAUAGAUUGUGUGUGAAGUUUUUAGAUAUUTUTAAUGUUGAUAARGAAAUAAAUU<br>GAAAAAAAAUAAAAAUAAUA |

| SEQ ID NO: | Sequence |
|---|---|
| 260 | ATTGATTTTTATTTTTTTUAATTTGATTTRGTTGTUAAUATTAGAATATUTGGAGGUT<br>TUAUAUAUAGATUTATATTRGGTTUTUTGGAAAUTUTGGGUUUTUATTUAUTURGG<br>GUTGTGUUUUAUUTUUAAAGGUUATGGAUTUTUXGTTTAUUUAGTTUUUAUUTUUT<br>UTATTGTUUTUTGAUTAAAAATUTTTGGTTGTGAUTUTRGTTGAGGUATTGTAGAG<br>UAGGGTGTGGUAUTGTTTGGGUTGGGUAUARGTGTTUAGGGGGUUAGAGUUAGG<br>AGAGGGUXGAAAUTUT |
| 261 | RGGGTGRGGAUURGUUAUUTGURGUAUUUTUUTTUUUAAUUUTGUUUTTUUUU<br>AUUUUUAUUUUAUTUUUAUUUUUAAUUUURGUTRGGRGUUUUAUUURGAUUUT<br>GUUTGUURGGGUAUUTRGGGGRGTURGUTRGURGGUTTXGUUTUUAUTTGUUURGG<br>UAGGRGRGRGTGGGUTRGGRGTUARGRGUTUUTUUTRGAUTGTGRGGUTUURGRG<br>UTGURGGGTTTUUTGTTUAAUAATAUAAUUAGGGAGGUAURGGRGGAGAGRGURGG<br>GUAGAAUTUUTUURGGAUTG |
| 262 | UAGTURGGGAGGAAGTTUTGUURGGRGUTUTURGURGGTGUUTUUUTGGTTATATT<br>GTTGAAUAGGAAAUURGGUARGRGGGAGURGUAUAGTRGAGGAGGGAGRGRGGG<br>ARGURGAGUUUARGRGRGUUTGURGGGGUAAGTGGAGGXGAAGURGGRGAGRGGA<br>RGUUURGAGGTGUURGGGUAGGUAGGGTRGGGAGTGGGGRGURGAGRGGGGTTG<br>GGGGTGGGAAGTGGGGTGGGGGTGGGGAAAGGGUAGGGTTGGGAAGGGAAGGGTG<br>RGGUAGGTGGRGGGTURGUAUURG |
| 263 | GGUAAGGUAGTUTGGGRGURGTUTURGGTUTRGGGGUUTGRGGTRGGGGUAURGRG<br>GTGURGRGTTTGAGURGGUAGUTUUUTGRGGAAATTAUAGGGGRGUTRGGRGUTG<br>RGGTRGRGUUUURGGGGUAGRGUURGUTGGTTGGAGGXGTTTAAATTGAAAGUAG<br>UTTTGGGGAGAGGGGGRGGARGRGGGURGURGAGUAAGGGGAGGGGGRGGUURGG<br>UAUAGRGAUUUUATTGTUTGTGUURGURGAGGGGTGGAAAUUTTGRGGTGAGUTRGG<br>RGRGGRGUUUUTUUURGAGU |
| 264 | GUTRGGGGAGGGGGRGURGRGURGAGUTUAURGUAAGGTTUUAUUUUTRGGRGGG<br>UAUAGAUAATGGGGTRGUTGTGURGGGURGUUUUTUUUUTTGUTRGGRGGUURGR<br>GTURGUUUUUTUTUUUUAAAGUTGUTTTUAATTTAAAXGUUTUUAAUUAGRGGGRG<br>UTGUUURGGGGGGRGRGAURGUAGRGURGAGRGUUUUTGTAATTTURGUAGGGAG<br>UTGAURGGUTAAAARGRGGUAURGRGGTGUUURGAURGUAGGUUURGAGAURGGA<br>GARGGRGUUUAGAUTGUUTTGUU |
| 265 | GGAGGGAGUUTGUAUTUTGGGUAGTGATGTGGAGUTAGAGAUTUUUAAGTTUATGG<br>TGUAAGTUTGTGGGAGAGUAGAAUTUAUTTAUAAAATTGTTGAUAGURGGTGTTG<br>TTAGAGARGGAAAGGGAUAAUUURGGUTUUTUTUUAGGXGTGGAGTUTGTGGGAT<br>GTGUTTUUAGAAAATGUAGGGTTAAGUAGGAGUTGUAGAGUAGAAUAAATGAUA<br>ATGAUTUAUTGUTGUAUTAAUAGGUTUTTTGTGGGGUTGTAGGTGGGAGGRGAT<br>ATGGURGGUAUUTTRGUAUAA |
| 266 | TTGTGRGAAGGTGURGGUUATATRGUUTUUUAUUTAUAGUUUUUAUAAAGAGUUT<br>GTTAGTGAUAGUAGTGAGTUATTGTUATTTGATTUTAUTUTGUAGUTUUTGUTAAU<br>UUTGUATTTTUTGGAAGUAUAUUUUUAUAGAUTUUAXGUUTGGAGAGGAGURGGG<br>GTTGUUUTTURGTUTUTAAUAAUAURGGUTGUAAUAATTTTGTAAAGTGAGTTU<br>TGUTUTUUUAUAGAUTUGUAUUATGAAUTUGGAAATUTUTGAUTUUAUAUAUTGU<br>UUAGAGTGUAGGUTUUUTUU |
| 267 | GTTUTGGTTRGGUAGAGTGGRGGUAAUTUUGUUTUTUTUTAGAAUAUUTAAAGA<br>AGUUAGTGAGTGAGUTGUTUATGUAUAURGGGGAGAUUTAUAGARGGAUUUAGGA<br>GGAGRGGGAGUUATTGAUTGUAUAUUUUAAUUURGGXGTGATAGGAAAGTGAGG<br>UUAUUTGTUUTAAGTGUURGGGGGUAGGGGGGTUUATGGAGGGGGRGGGGGU<br>AGGTGTUTGGAUAUAGGGATGUTGGUTUUAGGTGGUAUAGUTGGGGAGAAAAAAU<br>UTATUUATTGUAAAAUATUATTAG |
| 268 | TAATGATGTTTTGUAATGGATAGGTTTTTTUTUUUAGUTGTGUUAUUTGAGAUUAG<br>UATUUUTGTGTUUAGAUAUUTGUUUURGUUUUUTUUTUUAUGGAAUUUUTGUUU<br>URGGGUAUUAGGAUAGGTGGUUTAUTTTUUTATUAXGURGGGTTGGAAGTGTGU<br>AGTUAATGAGUTUURGUTUUTUUTGGAUURGTUTGTAGGUTUUURGGTGTGUATG<br>AGUAGUTUAUTAUTGGUTTUTTAGGTGTTUTAGAGAGAGGUAAGATTGURGU<br>UAUTUTGURGAAUUAGAAUA |
| 269 | RGTGATUAGAGAUAGAAAUAGUTUUUTUUTUUUTUAUTGAGUTTGTAGUUAUTT<br>TAAGTATAAUUTGTGTUUTGTGUUAGTTUUAUUATAAAUAGUUUTGAGTTTTTATUR<br>GGRGGUTTATTUTGUTGUUAAAAUUTTUAUAGTTGXGGGAATGGGUUAGGGAGAG<br>AGUURGGAUTTUAUTURGGUTGTGGTGAUTUARGUUTTTGGGAAGGGUTGAGGTAT<br>TTGTUUTTGGATGTGGGGATGUTGTGGUUTUTGGTTGGGAAUAUAGUUTRGTTTTGT<br>UTGTGGUTUTGGUTTUU |
| 270 | GGAAGUUAGAGUUAGUAGAUAAAARGAGGUTGTGTTUUUAAUUAGAGGUUAUAGU<br>ATUUUUAUAUUAAGGAUAAAUAUUUAGUUUTUUUAAAGGRGTGAGUAUUAU<br>AGURGGAGUAAAGUURGGGUUTUTUUUTGGUUUAUUUUXGUAAUUAATGAAGGTT<br>TTGGUAGUAGAAUAAGURGURGGAUAGAAUUAGGGUUGAUUUATGGUTGGAAUTGG |

-continued

| SEQ ID NO: | Sequence |
|---|---|
| | UAUAGGAUAUAGGUUAUAUUUAAAGUGGUUAUAAGUUUAGUGAGGGAGGAGGGGA GUUGAUUUUGUUUUGAUUARG |
| 271 | UAGUAUGUAUGUGUUUAUUUAAGGUAUUUGAGUUUUGGUUUUUGUGUUUUUUUUU UUUUUUimURGURGGGUUGUUGAGUUAAAUAUUUUAUR GGGGUUUUUGUUUUUUAGU UAGUAGUUAGUGUAGAGUUGUUGGGGUUUUUUGGUUUUXGUUUGGGUAGGUUUUUGUU AAUGAGUUAUUAAGUAURGGGAAAUAAGUGUAUAGGAAGGAGUAGGUGGUAAGAU UUUGUGGAGGUAGAGAUAGUUUUAUUUAGUGAGUGAGUUGUGAUUGUAAAUUUGGG AAGGUUUUGGGGGAAGUAA |
| 272 | UUGUUUUUUUUAGAAUUUUUUUAAAUUUGUAGUUAUAGUUAUUUAUUGAAUGGAA UUGUUUUUAUUUUUAUAGGGUUUUGUUAUUUGUUUUUUUGUGUAUUUAUUUUURG GUGUUUGGUGAUUAUUGAUAGAAGUUUGUUUAAGXGAGGUAGAAGGAUUUAGUA GUUUGUAUGAUGUUAGUUAAGGAGUAGGAGUUUUGGUGGGAUGUUGAGUUUAGU AAUUUGAGGGAGAAAGAAGGAAGGAAGAAUAGUAAAGGUUAGGGUUAGAUGUU UUAAAUGGAUAUAUGUAUAUG |
| 273 | RGGURGRGGGGGRGUUUGGAGGAGGGAAGUUUUUURGGAGGAGAAGAGAGUUGGGR GGURGURGUAGGAGGAAGRGGAAAGAUAAGGGGUUUUURGGUURGGURGGGGGURGUR GGARGUUUAGGAGUUUAAUGGGGAUARGUR GGGUGGGGAXGGAGGUAGUUUUUG UURGGAUAGRGAAAUUURGRGAGGUUUUAGGAGAGAGRGGUAGUUAGRGRGGUAUAGUU RGGGAGUUGRGGGUUUUARGURGGAGUUUUARGGAUAUGGGUURGGAAGGGAUAAAAA URGGGURGGAGUUAGRGUUGGAGUU |
| 274 | GGUUUUAGRGUUGAUUURGGUURGGUUUUUGUUUUUUURGAGUUUUAUGUURGUAGG UUURGGRGUGGGURGUAGUUUURGGGUUGUGURGRGUUGUUGURGUUUUUUGG UUURGRGGGUUURGUUGURGGAUAGGGAGUUGUUUUXGUUUUAUURGARGUGUUU UUAUUGAGGUUUUGGGRGUURGGRGGUUURGURGAGURGAGGGUUUUUAUUUUU URGUUUUUUUUAR GGRGGURGUUUAGUUUUUUUUUURGGAGAGGUUUUUUUUUU UUAGGRGUUUUUURGRGGURG |
| 275 | GUAUAUAUAUUUUUUUUGUUUUUUGUGUUAAUUUAGUUUUAUUUAUUGUUUAUU UUGUUUUUAAUUUUAUUUUUUARGUUUGUGUGUAUUUGGAUUUGUUUUUUUUGAA AUUGUAUGUUAUAUAUUUUUUUUAUUUUGUGUGXGUUUUUUUGUUUUAAGG AUUGUGGAUUAGGAUUUURGGGUUUUUUUUUAUUUUUUUUUURGUUUGGGUU UAUUAUUAUUUAGUUAUUUUUGGUAGUUUAUUUUGUUUUUGUUAAGAUUUUAGU UUUUAUUUUUUUGGUUUU |
| 276 | AGAAUUAGGAGGGUGGAGGUUGGGGGUUUUGGGGUAGGAGUGAAGUUGUUUAGGAAA GUGGUUGAAAUGGUAGUGAGGGUUUUAARGGGGAAGAGAGAUGGGGGAGAAAGUURG GGAGUUUUGAGUUUAUAGGUUUGAUAGGGUAAGAGGGAXGUAGUAGAAGUAGAA GGGAGAGUGGAUGGUAUGUAAUUUAGGAAAAUAAGUUUAAGGUGUAGUAGUAGG RGUGGGAGGUGGAAUUGGGGGUAGAGGUGUAUAGUGGUGGAAUGGUUGGUAGUAG GGAGAUAGGGAGGGAUGUGUGAUGU |
| 277 | GGUGGRGAUGUUUAGUUAUUGUUUUUUGUUUUUUUUAUAUAAAUGUAUUUGU UUUUUUUUAGAUGUURGGUUUAAUGGGAUUGGAUUUAUUUUAAAAGUUUGGUUUG UUUUGAUUGAAAAUUAGUGUGUUUUUUAUGGUUAXGGARGGUGUGUAGGUUUUUG UUUUGUUGAAGGGAAUUGGUUGAUUUUGAGUUAGURGUGUAUURGGGUGUGAUGU AGUUUUAGUGUGAUGGUUAAAUUUUAAGUGUAAUUUGAUUGGGUUAAGGAAUGUUA GAUAUUAUUUURGGG |
| 278 | UURGGAAAUAAUGUUUGGUAUUUUUAGUUUUAGUUAAAUUGAUAUUUAAAGUUUAA UUAUAUAUUGAGAUUAUAUUAGUAGUUUGGGUGUARGGUUGAUUUAGAGUGAGU UAAUUUUUUUAAUAAAAAUAAAAAUUGUAUAGURGUUXGUAAUUAUGGGGAGUA UAUUGGUUUUUAAUUAGAGGUAAAUUAGGAUUUUUGAAGAUAAAUUUAGUUUUAUU AAGURGGAUAUUUGGAAAGAAGUAGGAUAUAUUUGUGUGAAAGAGGAUAGAGAAG UAGGUGGUUAGAGUAURGUUAUU |
| 279 | GGUUUUGGGUGUGGAAUAUUUUGGAGGGUUGUUUUAGUGUUUUAUUAAUGUUUUAG UUAAAGAAUUAUUUUGUUUUUUUAGUUUUUUGUAGGAUAGGUGGGAAAGGGURGG GUGUUGGUUUGUUGUUAGGGGAUAGUGUAGGUGUGAUXGUURGGGUAGAGAUGA GUUAUUUUUUAUAUGUGUUUGUGUURGUUUUARGUUUAGUUUUAGUURGUGUGGUGGU UAAGAAGGGGRGAUUUUAUUAGAAUAUAUGGGUAUAAAUGUAUUUUUGAAA AUGGAAAUAAAAAUAAUUUA |
| 280 | UGGGUUAUUUUUGUUUUAUUUUAAAGGUAGUAUUAAAUGGAUUGGUGUGAUUU AGGAAURGUUUUUUUUGAUUAUARGAGUUAAAAUAGGRGUGGAGARGGGUAGU AAGAAUAGUGUGGAGGGUGAUUAUAUUUGUURGGAXGGUUAAAUUUGUAUGUUUU UUGGUAGUAGGAUUAGAUAUUURGUUUUUUUUUUAAUUUGUUUGUAGAAGGUUAAG GGGAUAGGGUGGUUUUUAAUUAGGGUAUUGGUGUGGGUAUAAAAUAGUUUUUUA GGAUGUUUAUAUUUAAAAUU |
| 281 | UAGAAUUUGAGRGAUGAAGUGARGGGAUUUAGUUAGGUUUAUGAAGAGUUAAUGGU AUUUGUUUUUUAUAAUUUUUUUAGUUUUUAUUGGUUAAUUURGUUUGUUUUURGRGUG |

| SEQ ID NO: | Sequence |
|---|---|
| | ATUTTTTGGATUTGAAGTGGTGTTTUAGGAUURGGAGXGTGGUUTGUAUTGUUTTG<br>TTUTGTTTGTTTGTGUAURGGATTUATRGTGAUTUATUUTGAGTUATUUAGGUAGTA<br>TGGAAGAAUTTTGGAGTTATTTTAAAUUUTTTGGUTUAGAAUUUAUUTTGGAGGAT<br>ATTAAUAUGUAAGAUAA |
| 282 | TTATUTTGUATGTTAATTUTAGAAGAAATGGGGTTUTGAGUUAAAGGGTTTAAAATA<br>AUTUUAAAGTUTTUUUAUAUGUUTGGAUGAUTUAGGAUGAGUUARGAUGAAUURG<br>GUGUAUAAAUAAAUAGAAUAAGGUAGUGUAGGUUAXGUUURGGGUUUTGAAAUAU<br>UAUUUAGAUUAAAAAGAUUARGRGAGGGAUAGARGGGGTTGGUAAUGGGGAUUG<br>GAAGGATTATGGGAGGUAAGTGUUAUUGAUUUTTAUAGGUUUTGAUTAAAUUUURGT<br>UAUUUUATRGUUAGGTTUTG |
| 283 | GUUUUTTGGUAUUAGGAUAUAUUUUUUUAUUUUTUTUUUAGAUUUUUUTUUUTGAUU<br>TUUTTAGAGUAGUUAUUUUTGGAGUTGUUAARGUUUUTGRXXRGGAAGGTTGAAUR<br>UUAUAGUUTGGUTUAUUAUUUURGGGUUAGUUAAXGUUUUUUUUUUUUUUG<br>TGAAUUAUAGUUTGGUTUAUUAUAUURGGGTTAGUUAARGUAUUUUUUUUUUUT<br>UUTUTGAAUUARGGUTTGGUTUAUAUUAUUTUGGGTTAATTTAGGGUUTTUUUAUAG<br>ATAGTUTGAAAAGGGGGA |
| 284 | TUUUUTTTTAGAUUAUAUUGTGGAGAAAGUUUUAAATUAAUUUAGAAGUAGAUGAGUU<br>AAGURGUGGTTUAGAGGGGAGAAGAGAAAGAGTGRGTTGAGUUAAUURGGAAGTAGA<br>UGAGUUAAGUTGUGGTTUAGAGGGGAGAAAAGAAGAGGGGXGTTGAGUUAAUURGGA<br>AGUAGAUGAGUUAAGUTGUGGTTUAGAGGGGAGAAGAGAAGAGGGGRGTTGAGUAAU<br>UUUAAGGATGGUUTGUUUUTAAAAGAGGGUAAGGAGAAGGGGTUTGGGGAGAGGGTGGGGAG<br>GGTGATGTUUTGGTGUUAAGGGGAU |
| 285 | UTGAGTUAAUAAGGGUTGAUAAGGGTUGTGTTTUTGGAUGUAGGGUUUGGGUAGAUGUTUUG<br>AGGGGGGGAGGTGGGUUAGUUTGGGAGGUUUTUAGGAGUAAGGGGGUUGGTGRGGGGTGUR<br>GAGGUUAUAUGAAGGTUAUTRGAUUTGURGGGGAGGTGGGGGUXGUUUTUTGTGATGGAGU<br>AUTTTGAAGATGAAGAGUUTGAGUAGGGTGAGTGTGTGTGAGAUUUAUAUATGRGUAUAT<br>GUGTAUAGGUAGAGAGAGAUUAGAGAUAAAAUAGAGAGAGAUAGAGAAAGGGAT<br>AGAGAUGGGGAGGGGAGAUAGAAA |
| 286 | TTTUTGTUTUUUTUUUUAUAUUTUATUUUTTUTUTGUTUUUTUTGTTUGUTUTUTGAG<br>TUTUTUTUTGUUTGUAUAUAUGTGRGUAUAUGGGUTUUAUAUAUAUAUAUUAUUTGUTU<br>AAGUTUTTAUTUUUUAAAAUUGUUUAUUAUAAAAGGXGGGUUUUUAUUUUUURGGUAGGGTR<br>GATGAUUUUAUGGGGGUUTGGUUAUURGGUAUUUAGGUUUGRGTGUUUUGAGGGGGUUUUUUU<br>AGGGUUGGUUAUUTUUUUUUAAAUAUUTGURGGGUUTUGUAUUUAGAAUAUAGUUUT<br>TGTUAGUUTTGTTGAUTUUAG |
| 287 | TTRGTGUAUUTUTGRGGURGRGGRGGUAGUAGUGRGGRGGRGGGUUAGUTUUURGGT<br>UTARGTGUUUAUUAUUURGRGTGGGGTTUUAUGTUGUURGGUUUAURGTAUUAUUTGU<br>AGGGGGTRGGGUAGTGGGGUUAGUUAAUUARGRGGGRGGXGRGGGGRGRGUAUUURGG<br>UTGGGUUTUAGGGUUUTRGGURGAUAGUUUTUUAUARGGUAGRGGAGGRGGRGRGGUT<br>GGRGGRGGGGURGRGGGGUUUTGGRGGRGUTGGUUAGURGRGGRGUAGRTUTRGGR<br>GRGUTTUUUUUTAUTUTUUUAGU |
| 288 | GUTGGGAGAGTAGGGGGAAGRGRGURGAGARGTGRGURGRGGGUTGAGUUAGRGURG<br>UUAGGUUURGRGGUUURGURGUUAGRGRGURGUUTURGUTGURGTATGGAGGGGU<br>TGTRGGURGAGGUUTGAGGGUUAGURGGGGGTGRGRGUURGXGURGUUURGRGTGGTTG<br>GUTGGUUUAUTGUURGAUUUUTGUAGGTGGTARGGTAGGURGGGUUAGUAUTGGAAU<br>UUAARGRGGGUUGGTGGGUARGTAGAUURGGGGAGUTGGURGURGRGGUTGUTGU<br>RGURGRGGURGUAGAGTGUARGAA |
| 289 | TUTTTGTGTGAGTUAUGTGUTTATAUUUAAUAAGTAUUUAAAAAAAAGATTTTTTTTTTT<br>TTTTTTTAAGATGGAGTGTRGUTUTGTUAUUUAGGUTGGAGTGUAGTGGUAUGATUT<br>TGGUTUAUTGUAAUUUTGUUTUURGGGTTUAAGXGATTUTTTUTGUUTUAGGUTUU<br>TGAGTAGUTGGAATTAUAGGUAUGUUUUAUUAUAUUURGGUUAAUTTTTTATAUGUAA<br>TAGAAAAUAAGGTTUAUUAUGTTGGUUAGAUAGGUUTTGAAUUTTGAUUUAGGT<br>GAUUUAUUUAUUUTRGGU |
| 290 | GURGAGGTGGGTGGGATAAUUUTGAGGGTUAGGAGTTUAAGAUUTGUTUTGGUUAAUATG<br>GUGAAAUUTGTTUTUATUTAUAUAAAAAUUTAGURGGGUGTGGUGGGGUATGUUTG<br>TAATUUUAGUUTAUUTUAGGAGGUUTGAGGGUAGAAGAATXGUUUTGAAUURGGGAGGGUA<br>GAGGTUTGUAGUTGAGUUAAGAUAUTGUUTATGUAUTUUUAGUUTGGGUTGAUAGAGRG<br>AUAUUTAUAUUTAAAAAAAAAAAAAAAAAAUUUUUUUUUGAGTAUUUTGUUTGGAUAUA<br>AGAUAUGAUUAUAUAAAGA |
| 291 | AUUAUUUUUTGAUUUUTUATGAUUUUAUUUAGUTUUUTAAGTGUUUUTGGGUAUUUA<br>GUTUTTTTGTGGUAUGGGGURGGTGUAAGTTTUTATAUTGAGAGUUAGAGAGAUAGGGA<br>GGGAGGUUURGGGUTUUUTGGGUUUTTTTGGGAAAAGAUGUUUXGTUTUTAGAUUAGUAAA<br>AGGAGGUUAGUTGUTTTAGGAGUURGGGAAAAUGUUAUAUUTGAUAGUAUUAUUATT<br>ATTTTUUUAUTTTTUUUTTTTGTGTTTTTAAAAAUGAAAAGTTUAGAUUUAUGGGGUAGG<br>GUAGAGTGGGUUUTGGAGGGAG |

| SEQ ID NO: | Sequence |
|---|---|
| 292 | TUUUTUUAGGUUUAUTUTAUUUTAUUUUAUGGAUUUGAAUUUUUAUUUUAAAAU<br>AUAAAGGGAAAAUGGGAAAAUAAUAAUAAUAUUAUUAGUGAUGGUAUUUUUURGGG<br>UUUUUAAAGUAGUUGUUUUUUUUGUGGUUGAGAXGGGUAUUUUUUUUAAAAG<br>GUUAGGAGUURGGGUUUUUUUUGUUUUUUGGUUUUAUAUAGAAAUUUGUAU<br>RGGUUUAUGUUAUAAAGAAUUGGGUGUUUAGGGGUAUUUAGGAGUUGGGUGAGUU<br>AUGAGGGGUUAGGGGGUGGUU |
| 293 | GUAGUARGUAGUUUUUUAGGGGUUUUAAUUUAUUUUUUUUUUUUAUAGGGUUUU<br>UUUGURGUUUAGUUGUUUGGGUGAGAAAGGUGGAGGGGAUAUGUAGUUUURGGAUGGAG<br>GUGUAGUAUUAARGAGAGAGUGURGGUUUGUGGGAGGGAXGUUAGGGUUAGGUU<br>AAAGUUAGGAGUURGGGAAAAUUUGGGUUUAGURGUUUARGUUUUUARGGAGGGGAU<br>AUAUUUUUUUUGUUUGAUGGUAGGGUUUAUGGUAGAUAAAAUUUAUGAUUUAU<br>UUUUUUUUGGUUUUAGGGUUAGUU |
| 294 | GGUUGAGUUUUGGAGUUAGGAGAGGGUUGAGGUUAUGGGUUUUGUUAUUAUUGGGUUU<br>UGUUAUAGGUUAGGGAAGGGUGUUGUUUUUUURGUGGGRGUUGGUGGUGAAUUUA<br>GGUUUUUURGGAGUUUUUGGUUUGAUUUAAGUUUGAGXGUUUUUUUUAUAGGURGG<br>AGUUUUUUGUUGGUGUUGUAUUUUAUURGGGGUUAUAUGUUUUUUUUAUUUUUUT<br>UAUUUAAUAUUGGARGGUAGGGAAGUUUUUGUGAGGGAAGAGGGGGUGAGUUAGGG<br>UUUUUGGGGGUUGRGUGUGU |
| 295 | ATTTUTTTUTAUUUGUUAUUGAAGUGAAUAUUAGUAUAAGUAGRGAGUUGGGRGUA<br>TTUUTTUTAGUUUGUGUUAAAAAUUUGUUGGUAUUUUUURGGUAUUAGUUAGAGGUGUG<br>UARGGGUAUUGUUUUAAAAUUUGGGAAGGAGGGAAGAXGAGGUUAGGGAGURGGAGG<br>GUUAUUAAGGUAGAUUUUUAGUAGRGUUAGUUUAGUUGAAUAUUUUUUAGUUUUGU<br>UUUUUAGUAGUUUUGAGGAAAAGUAUAGGUUAAGAAUAAAGAUAAUUUAUUGUAUGUUU<br>GUUAUAUUGAAUGUAUAAUA |
| 296 | GUUAUGUAUUAUAUAGUAAAAUAUAGUGGUGUUUUGUUUUAUUAUUUAUUUUUUU<br>TUAAAGUUGUUGAAAAAUAAGGUUGAAAGUGUUUAGUUGAUUAGRGUUGUUGGA<br>AAUUUAUUUUGGUGAUUUUURGGUUUUUUGGUUUXGUUUGAAUUUUUUGGUUAUUA<br>AGUAGUUGUURGUAUAUAUUUUGUUGAUAURGGGGGAAUAUUAGUAAGUUUUAAU<br>AUAAAUUGAGAAGGAAUGRGUUUAGUURGUUAUUUAUAUUGAUGAUUUAUUUAAUG<br>AUAGGUAGAAAGAAAUG |
| 297 | ATTGGUTUUGGUUUUUUUUUUUAAUAUUUUUAUUURGGGAUGUAGUUAAGAGUUGGUUG<br>UAGUUUAAUUUUUAUAUGUAAAUAAUGAUUUAGUGAUGUUUARGGGGUUUUUUUT<br>UUGGUUUUUUUUUUUGGGAAAAGAUUGAGUUUUURGAXGGGUAUUUUUUUUUUU<br>RGGAAUUAAGGGUUUGGGAUGUUGAUAGUUUURGUUAUUUUGAGAAGGGUAGG<br>URGUGGAAAAUUAUUUUUUUUUUUUUUUUUUUGUGUUUUUAGUUGGGGUUU<br>UUGUAUAAUGUAGUUGGGUUA |
| 298 | TGGUUUAGUUGUAUUGUUGUAGAGGUUUUAGUUAGGAAAGGUAGAGGGGGAAGGAA<br>GGGAGGAGAUGGUUUUUUARGGUUUGUUUUUUUAGAGGUGGRGGGGGUGUAAU<br>AUUUUAGAGUUUUUGGUUURGGAGGGGGAGGGGAUGUUXGURGAGAAUUAGUUUT<br>TTUUUAGGGGGAGAAGGUUAGAGAGGGGUUUUUGUGGGUAUAUUGAGGUUAUUGU<br>TUAUAUGUAGAAAAUUAGGUUGUAGUUAUUUUGGUUGUAUUURGGGUGGGAGGUG<br>UUAGAAAGAGGAUUAGAUUAAT |
| 299 | TTGUUUUAUUUUAGGUUUUGGAGGAGGGUAGGUGUUUGGUUAGUAGAGUGGUUA<br>UUGUUUAUUGGUUUUAGAGGAAGUAAGGUUAUUAGUUUGAUUUUAUUUUUUUUR<br>GGUUUUAUUUUAUUUUUUUUUUUUAAUUAUAAGUUUUXGUUAAAAUAGAGAUUUU<br>RGGUUUUGUUUUUUUGUUGUAGGAAGGGAGAGUUAURGUUAGAUAUUGUUUGUUT<br>GGUUUUUUGUUUUGAUUUAUUURGGUUGUUUGGAAUAAAGAGGAUUUGGUUUUUU<br>TUTRGGGAUARGUGAUUUUUTT |
| 300 | AAGAAAAUUAURGUAUUURGAGAGGGAAGUUAGGUUUUUUUGAUUUUAAGUAURGG<br>GUGAGAUUAGAAUAGGAGGAUUAGGUAGGUAGUGUUGGRGGUGUUUUUUUU<br>UUGUAGUAGGGGAGUAAAGURGGGGUUUUUAUUUUGGXGGGGUUUUGUUGGUUGAGG<br>AGAGGGGAGUGAAGAUGGGURGGAGGGAGAAGUUGGGAUAGGUUGGUUGGUUUUGU<br>TUUUUUUGGGUUAGUGAGUAGUGGUUAUUUGUUGGUUAGGUAUUUAUUUUUUUUU<br>AAAGUUGGAGAUGAGGGUAAG |
| 301 | GUUUAGAUUAGGUAGRGGGGUURGUUUUUUUAGGAUUUUUAAGGUAGUUAAGGUU<br>GGAGGRGURGGRGAGUUUGGAGAGGGGAGGAGUUAUUAAAAUUGUGUUGGAUGGAAG<br>GRGURGAGGAURGGAGGAAUUAAUURGAUGUUGGGGAAGGXGGARGGGGUUARGAG<br>GAAAAAAGAGGGGGGUAAUGUAUAUUUAGUUUUUUUAUUAAUURGGRGGGGAGAUGGA<br>UGGUUUUURGGAUURGGGRGUUUUAGRGUUUURGGUUAGUUAUAGGGAGARGUUAGAG<br>RGUUUUGGUURGRGAUAGAAGA |
| 302 | TUUUUUAURGRGGAUUAGAGRGUUUUGAGUGUUUUUUUAUAGUUAAURGGGGRGUUG<br>GGARGUUGGUURGGAAAAUUAUUAUAUUUUUURGURGAGUGAUGAAAAGGUGAG<br>UGUAUAUUGUUUUUUUUTTTTTTUUTRGUAGUUUUURGUUXGUUUUUUUUAUAUURGGAUU<br>AAUUUUUURGGUUUURGARGUUUUUAUUAAUAUAAUUUAGUGAAUUUUUUUUUUU |

| SEQ ID NO: | Sequence |
|---|---|
| | UUAGGUTRGURGGRGUUTUUAGUUUAGUGUUUGAGAGUUUGGAGAGGGRGAU<br>UURGUTGUUTGAUTGGGU |
| 303 | ATTTGGUTTGAUTTAUTUUAAUAUUUUUAUAUUUUUUUUUAAAGAAAA<br>RGAGUGAAUAURGUGAUGGGUGUAGUUAUGUGAAUAAUUGGAUGGGAGGARGUGU<br>UAGGRGAUUUUUAGUUUUUGGGAGURGGARGUUUAXGUUUUUUUUGUUUGUUUT<br>UAUAGAUAUAUUUGUGGGGUGAUUAAUUAGGAAUUAUGUGUUAAAGUAAUUA<br>UAGUGGUGAGUGUUUGAURGGUUUGAUGUAGAAAUAAGGAAAAUAUUAGAAAAA<br>UAGGGGRGGAGGUUUAA |
| 304 | TTGGGUUUGUUUUGAUUUUUGUGUUUUUUGAUUUUAUAUAUUGU<br>AAAAUAUAUUAUGUAGUAUUUUGAGUAGUAUGAAUUUUGAGUAAAUAUUU<br>UAUAAAUGUGUUGUGAGAARGAGGAGGAGGXGUGGGGUGGGUUUUA<br>GGGUGGAGAURGUUGGUARGUUUUAUUAAUUAUUUAGAUAAAUUAUUU<br>AUARGAUAUUAUTGUUUUUUUUUUUUAGAGAGAAAGUGUAAAAAAUAUUAAA<br>AAUAAGAUAAGUUAAAT |
| 305 | TGAUUUUUAUUUUUUUAAGAUGAUUAUUAGGAGUGGUUUAAUAAAAUGAAUA<br>UAGAAUUUUGAGGGUUUAAUUAUGAUUAAUUAGAGUUUUUUGAAUUUUUAU<br>GAGUUAGUURGGUUUUUUUAUGAUUAUUAUUAGXGGGUAUUGUUUUUUUUT<br>UUUUUAUAUUUUUGUUUUUUUGGUUUUAGUUUGGUUUUUGAAUA<br>UAUUUUUAAUUUUUURGGUUUUAGGGAAAUUUGAGGUAAAUUGAGUGUA<br>GGGAGRGGGGGUURGU |
| 306 | GRGAAGUUUURGUUUUGUAUUAAAUUUGUUUUGGGUUUUUUGAGGGGGGURG<br>GGAAGAAUUGGAAGGUGUUGGGUUGAAUUAGUGUAGAGUGGAAAUUAAAAGAGA<br>AGUAAAAAGUGAUAAAAGAAGAAGAAAGAUAGGUGUUXGUAGGGUGAAGUUAGU<br>GGGGAGGGURGGGUGAUUAUGAAGAAUUAGGGAGGGUUGUUGAGUAUGA<br>UUGGGGUUUUUAAAAUUUGUGUUUAGUUUGUUGAAAUUAUUUUAAUGAUAUUT<br>UGAGAGAAAUGAAAAGUUA |
| 307 | GGTGUAGGAGUGGUUUAGGAGAGUAUUURGUUUUURGGUURGUAGGUGGUGUUUG<br>UUGGUUUUAGUAGGGUUAGGAGGGUUAUUGUAGUUGGUGUUUAGAUUGAUGUU<br>AUURGGGURGAGUGUGUGUUUURGGUAAUAUUGAUAUXGUUUGGUUUAAUUUUA<br>UUUUAUURGGGGAAUAAGAUUAAAUUUUUGGGUUUUUUUGGGGUUUGUUUAUUGUUT<br>UUUUUGUAAAGGUGAGAUUUAGGUUAGAAGUAGGGUAGARGUUUAGUUAGGAU<br>UAGUUAUAAAUAGUAUGGUGGT |
| 308 | AUUAUUAUGAUUGUUUGUGGUGGUUUGAGUGAGARGUUUGUUUGUUUGUUT<br>UUGAGGUUUAUUUUGUAGGGAAGGUAGUGGAUAAGGUUUAAGAAGUGAGGAG<br>GUUGAUUUGUUUUURGGUGGGUGAGGUUGGAUUAGGXGGUGUAAUGUUGURGG<br>AGGUAUAGUAUGGUURGGGUGAUAUAGUUGGAGUAUUAGGUUGUAGGUGGU<br>UUUUUGGUUUGUGGAGUUAGUAAAUAUUAUUUGRGGGURGGGGAARGGGGUGU<br>UUUUUGGGUUAUUUUGAUAUU |
| 309 | GUAGUUUUAUUUUGUUGGUGAUUAUAUAAGUUUGGGGGAAGGAAUGGU<br>AGUGGUUUUUUAUUUUUAUGUUUUGRGGUUAUAAAUGGUAGUUGAUAUAAUU<br>AUUUGUAGGUUUURGGGAGUUAUXGGGGUUUUUUGAUAXGUUGUUAUUAGUGGUUT<br>UGAGGAGRGUUUGUUUUAUUGUUUUUAXGUUUUUUAXGUUGUUAUUUAGGG<br>UUUAUUAGRGUAAUGGUAAAUGUUUGUGUUUUUAUUAURGGGAAAAUAUUUUU<br>UUUUUUAGAGRGGAGGUUAGU |
| 310 | UTGGUUURGUUUGGAGAAGGGAGAUGUUUUURGGUAGAUGAGAGUAUAGGGUAT<br>TGURGAUUAGRGUAAUGGAUUUGGAGUGGUUAGAXGUGGGGUAXGUGGGGUA<br>GGUGGGGUAGGRGUUUUAGAAGUUAUUAAUGAGUAXGUGUAAGAGGUUUXGA<br>TGGUUUURGGGGUUUGUAGGUGGUUAUGUUAAUUGUUUAUUGUGGURGUAGAGGUA<br>GUAAAGGUGAAGAGGGUUAUUGUUAUUUUUUUUUUUAGGGUUUGUAGUGAGUUAUU<br>AGGUAGGUGAAGAGGGUGUT |
| 311 | GTGGUUUUUUUAUUUUAUGUUUUGRGGUUAUAAUGGGUAGUUGAUAUAAUUA<br>UUTGUAGGUUURGGGAGUUAURGGGGUUUUUGAUAXGUGUUAUUAGUGGUUUT<br>GAGGAGRGUUUGUUUUAUUGUUUUAXGUGUUUUUAXGUUTGGUUAUUUAGGGT<br>UUAUUAGRGUAAURGGUAAAUGUUUGUGUUUUUAUUAURGGGAAAAUAUUUUU<br>TTUUUUUAGAGRGGAGGUUAGUUUAAAAAUUAGGUURGUAGUUURGAGGUUUTGA<br>AAAUUAAGRGGUGUTTUTGGTU |
| 312 | AUUAGAAUAGURGUUGGUUUUAGAGUUUGGAGGUGRGGGUUUGGUUUUAGG<br>UTGGUUURGUUUGGAGAAGGGAGAUGUUUUURGGUAGAUGAGAGUAUAGGGUAT<br>TGURGAUUAGRGUAAUGGAUUUGGAGUGGUUAGAXGUGGGGUAXGUGGGGUA<br>GGUGGGGUAGGRGUUUUAGAAGUUAUUAAUGAGUAXGUGUAAGAGGUUURGA<br>TGGUUUURGGGGUUUGUAGGUGGUUAUGUUAAUUGUUUAUUGUGGURGUAGAGGUA<br>GUAAAGGUGAAGAGGGUUAUT |
| 313 | ATGGGUUUGGGGURGURGUUUAGUGUUUUUGGUGUUGUAGURGGGUAGGGURG<br>AAUUUUGGRGUAUAGUUUUUGUUGAGUGUUUUUUUUUUAAGGUUGUUGUGGGRGG |

| SEQ ID NO: | Sequence |
|---|---|
| | UTUTGURGGUUUUTUUTGUAUUUGUUUAGGUUUUGGGXGGAGGUUUUUUTUURG GGGGGGUTGUGGUUUAGUAUAGAUUAGGGGAUAGAAGGUGGUUUUUUUGGUUUU GGUGGGUGUGAAUUAAAGAUUUUUGUAAGAAAUUUUUUUUUUUUUUUUUUUUUU TRGUUUUUUAUUUUUUUUU |
| 314 | GGGAGAGAGAUGAGGGAGRGAAGGAGGGAGAGGGAGAGGGGGAUUUUUUAUAGGA AGUUUUGGUUUAUAUUUAGUUAAGGUUAAGAAGAGUUAUUUUGUGUUUUGGUU UGUGUGAGGUUAUAGUUUUUURGGGAGGAGGAGUUUXGUUUAGGGUUGGGUA GGUGUAGGAGGGGURGGUAGAGURGUUUAUAGAUAGUUUUAGAGAGGGAGAUUUA GUAGGAAGUUGUGRGUUAGGGUUUGGUUUUGUURGGUUGUAGUAUUAGAAGAUAU UGAGGRGGRGGUUUUAGGGUUUAU |
| 315 | UAUUGGAUUAUUUAUAUAAUUUUUGAGGAUUAGUGGAAAUGAAAAUARGGUGUUUR GGUAUAAAAUAUAUUUAUAGUUUGGGUUAGGUAAUAGUAAAGUAUARGUUGAGR GURGGGAUUUUGUGAGUUAGGXGGUGGGXGAAGUUUUGAGUGUAUAUAUAUUUAR GAXGUURGGUUUGUUUAUAGRGGUUUUGGGGUUAGRGAUUGGUAUUUAUUUGUA UUUAAGGGGAGGAAAUUGAGGUARGAAUUGUUUAGAAGUGUUUUGAGGUUAUU AAGUGAGUAGGAAGAGGRGT |
| 316 | RGUUUUUUUUUAGUUUAUUUGGUGAUUUUAGGGUAOUUUUGAAUAGUUUGRGUGUUU UAGUUUUUUUUUUGRGUGAAAUGUAGGUAAUAUUUAGUUGUAUUUUAGAGGGGURGUT GUGGGAGUAGGGUURGGXGUUGUGGGUGUGUGAUURGGGGUUUXGUUUAUXGUUU GUAUUUAGAAGGUUURGGRGUUUAGRGUGAUGUUUUGUUGUUUGUUAAUUUAAGUU AUGAAAUAUGUUUUGUGURGGGGUAURGUGUUUUUAUUUUUAUGAUUUUAAAAGU UGUGUGGAUGGUUUAGUGT |
| 317 | UUUUAGUGUGUUUAGUUGGUUUUAUUGUAAAAAUGGGGUUUAGGUUARGAUUGGUG UUUUUUUUAUAGAGAAGUUAUUUUAGGUAGGGUUGGGUGGGGUGGAAUURGUUUUU AAUGGUUUURGGGGAUAGUUUUGUAGUUAURGGUGAUUXGGGUUXGUUTGRGGAUUUU UUUURGGUUUAUUUAUUUAGGGAUAGUUUGUAAUUGGGGUUUUUUAAAA AAARGUAUGGUUUUUUGUUUUUUAAAAUUUAGUUUAAGGUUAGUUAUUUUUUUUUU UUUURGGGGGGUUGAAAAAUUUA |
| 318 | GGUUUUUAGUUUURGGAGGAGGGAGGGAAUGGUUGURGUUAAGUUGGUUUUGGGG GAUAGGAAGGUUAUGRGUUUUUUGGGAGGGAGUUUUAUUUGUAGGGUGUUUUUGA AUGGAGUGGAGGURGGGAAAGAUURGUAGAXGAAUUXGAGUUAURGGUGGUUGUA GGGUGUUUURGGGGGUUAUUUGAGAARGAGUUUUAUUUUUUAUUUAUUUUUGUUUGG AGUGUUUUUGUAAAGGGAAUAUUAGUUGUGGUUUGGUUUUUAUUUUUAUAGAAA AUUAAUUGAGGUAUAUAUGGAGG |
| 319 | UAUUUARGGGUUAGUUURGUUAGGUGUUGARGGAUGUUAUUUAGGUGUGAGUUUUG UAUUUGAGUUUUUUUUGUAUAUUAGGUUAGUUUAUAAUUUAGUUAGUGUAGAGGUGAG UUUUGUGGUUAGUGAGGAGURGGUGAGUUAAAUUUUUUXGUUUARGGGUUUUGAG ARGURGGUURGUGAGUUGRGGGGUGAGGGRGUUUAUAUUAAGUUAAGGUUGAG GUAGUGAUAUAUUUUUUAUGGGUUUGUUTRGUUUUGUUUAUUGUUUGGUUT UUUUUTUTRGUAUGGAGGAUA |
| 320 | TGAUUUUUUAUARGAGAGGGAGAGAUUAGGAUAAUGAAGUAGGGAGRGAGAGUAG GUUUAUAAGAGGGUGUGUAUUGUUUAGUUUUGGUUUAAUAUAGGRGUUUURGAU UURGUAAGUUUUARGGAGUURGGRGUUUAGGGUUURGUAGGXGGGAGGAGGUUGAUU UAURGGUUUUUAUUGGUAUAGGUUUAUUUUUGUAAUUGGUUUGUGGUUGUU UGUGUUAGGGGGGAGUUUAGGUGUAGAGUUAUAUAUUUGAGUGAUAURGUAAUA UUUGARGGAGUUAGUURGUGAGUG |
| 321 | UUUAGGUUGUUUGGGUUUUGGUUUUUUAUUUAUGUUAGUUUGGUGUURGAUUUGUGUUGAGAUUUU UUUUUGUUUUGGUURGGGUGUUUAUUUAAGUAAUGGAUAGGUUGGAAUAGGXGUUUXGUA GGGAAXGGGUUGAAXGUURGRGGUUUUXGXGAUGUUUXGXGAUAUUAUUUUUUXGUUUUX GUUUAUUAAGGAUURGGAAGUAGUAAAGUUURGURGTRGRGUUUUURGUUUURGRGTUUUUUUT GGUAAUUAGUUUUUUUUUUUUUTRGUUUAUAAGGAGUAAGRGGUAUAAAUAGGG |
| 322 | UUURGAUUUGUGURGUUUGUUUUUAUGGRGAGGGAAGGGAGAGGUUGGUUAUUAGGGAGA RGRGGGGRGGGGGRGRGARGGRGGGUUUUGUAUUUURGGUUUUAAGUGAGXGGGGGXG AGGGAGGUAGUAUXGXGAGAUAUXGXGGGAGURGRGGGXGUUUAGUUXGUUUUUUTAXGAAX GUUTGUUUAAUUUGUUAUUGUUUGGAUGGGAUAUURGGGUUAGAGGUAGGGAGGGUUUU AAAUAUAGGUAGGGAUAUUAAGUUAGUAUGGUGGAGAUUAAAAUUUAGGUAGUUUGG |
| 323 | UAAUGGUUUUUUUUUAGUUURGGUGGGRGUGGUGGGGGAAUUUUAGGGRGGGR GGGGGGUAGGGGUGGUGUGAGUUAUUUAGUUUGGUUAGGUUUUUGUUUGUUAG UUUUUUTGUUUUUAAURGUAUAGUURGUUURGGAUUUAXGAGGGUUUAGUUAGUUUAU UUUUGGAUUUUUGAGAUXGAAUUGUAAAUUUGUURGGGGUUUGGUUUUGAAUUUUUGU TGUUUUAGGGAUUAAGUUUUGUGGUUUUUAGGGGGGUAUAGUUGAUUUUUUAAGUUGA GUUGGUUUAGGGUUUUTUUGUAU |
| 324 | TGUAGAGGUUUUUGAGGUUAGUUUAGUUUGAGAGAUUAUUGUGUUUUUUUTGGGAGU UAUAGGAUUUGGUUUUUAAAUAGUAGGAGUUUAAGGUUUAGGUURGGGUAGUUUGU |

| SEQ ID NO: | Sequence |
|---|---|
| | AATTXGGTUTUAGGAGTUUAGAGGTGGUTGGUTGGGUUTXGTAGATURGGGGRGGG<br>UTGTAGRGGTGGGGGUAGGGGGUTGGUAGGUAGGGAUUTGGUUAGGUTGGGTGAU<br>TUAGUAUUAUUUUUTGUUUURGUURGUUUTGGGGTUUUUUAGUUAGGGTGGTTA<br>GAGGUTGAAGAAAGAGGUUATTGT |
| 325 | AUUUTGTGUAGGGUUTGUAUUURGGAAGGUUTUUAUUAGUURGAAUUTGGUURGT<br>URGUUUTAGATGGGGUAATRGGRGTTTUTUURGGGAUAGUUTUUTUUUTGGUUTUU<br>TGGUUUTRGTUTGUATTGAGAGGUUTGGUUTUTGGUTUXGUATGUTGUUUTUURGT<br>GUTGTGGUUTGUAGUURGGUUTUTUUUUTGUTGUUUUUTTGGUTUTGGUTGGU<br>UUUTGGGUUUUTGAGTUAUUUUTGAGGTGAUUAGUAGUUUTTGGAAARGUATGUR<br>GAGGARGUAUUUTGUUTGGUU |
| 326 | GUUAGGUAGGGTGRGTUUTRGGUATGRGTUUUAAGGAUTGUTGAGUAUUUTAGG<br>GGTGAUUAGGGGUUUAGGGGUUAGGUUAGAGUUAAGGGGGAUAGUAGGGGAGA<br>GGURGGGUTGUAAGGUUAUAGUARGGGAAGGGUAGUATGXGGAUUAGAGGUUAA<br>GUUUTUAATGUAGARGAGGGUUAGGAGGUUAGGAGGAGGUTGUURGGGAGAA<br>ARGURGATTGUUUUAUTUAGGGRGGARGGGUUAGGUTRGGGUTGGTGGAGGUUTTU<br>RGGGATGUAGGUUUTGUAUAGGGTT |
| 327 | GGAAUUATTGUTGUTGUUAUAGUTGRGTGGAGGGATTURGGUUTRGGGTTUA<br>GTTGGTGAUAGTGTRGGGTAGGUUTGGGUAGGTGGGAGAGGTRGTGAAGUUUTTG<br>UAGGGUAUUTGGURGUTUATUTGUAUAGGGGAAGAGGXGUAGUURGTGGUURGG<br>UAGTUUAGGAUUTGUTGTTUUUTTUUTAUURGGGGRGGGGUUTGTGGGAAGATATG<br>GAAGTRGGGTGAATGAGURGTGUUUAGTGAUTTTAAAAGUAGAUUAAAAUAAUAT<br>AGAAAATGUAGAGUTAUTG |
| 328 | UAAUTGAGUTUTGAUAUUTTTUTAUGTUATUUUAAUTUGUTUTUTAAAAUUAUGGGUAR<br>GGUUAUUAAUURGAUUUUAUAUUUUUAUAGGUUUURGUUURGGGUAGGAAGGG<br>AAUUAGUAGGUUUTGGAUUGURGGGUUARGGGUTGXGUUUTUUUUUTGUUAGAU<br>GAGRGGUUAAGUGUUUTGUAAAGGGUUUAARGAUUUTUUUAUUTGUUUAGGUUT<br>AUURGAUAUGUAUUAAUGUGAAUURGAGGAURGGAAUUUUUUARGUAGUTGUG<br>GGUAGUAGAAUAAUGGUUUU |
| 329 | GUAUUUUAUUTGRGUURGAAGRUAGAUGGAGUUUAAGGGAAAGGUUUTGTAGA<br>GGAUUURGTGUGAUUTGGGGUAAAGRGTGGUUUUUAGGGGGGUGRGTGGGUAGRGG<br>GARGUUUATGGUTGUAURGGGUUTGUGUUUTUUAUAGGGAUXGTUTGUUUUTGUAG<br>AGAGUUUUTGTGGGGXGGGAAGTGGXGAGUAGURGGUAAGGAGGUUUAGUUAGA<br>UAGAAGUAGGGGGGUAGGGAUAUGGGAGGTGGGGGAUUAGUUAGUGAGUAGAR<br>GTGAGGAUUUAGTGUUAAGGAUTG |
| 330 | UAGTUUTTGGUAUTGAAGUUUTUARGUTUGAUAUATGGGGUUTUTUUUTGGGTUU<br>ATGUUUUUTGAUUUUUUUTGUTTUTGUGUUGGUTGGGUUTUUUTTGURGGUTGUTXGUUA<br>UTTUUXGUUUUAUAGGGUUTUUTGUAUAGGGUAGAXGGUUUUUTATGGAGGUAUA<br>AAUURGGGUUAUAUUAUUGGGRGUUURGUUGUUUUARGUAUUUUUTGGGAGGUUARGUU<br>TTGUUUUAAGTUAUARGGGGUUUTUTAUAGGGUUUTTUUUUTGGGUUUUAUTUGRG<br>UUTRGGARGUAGGTGAGGATGU |
| 331 | AGGTTUUUUAUUUTAGUTUUURGGAUUUTUAUAGGGAGTGUUAGGGAUUUTAAU<br>UUUUAGGGUUUAUUTUTGUAGGAGUUTRGGGTTRGAGGUUUARGUGGUUAGAAGAGU<br>TUAGGUUUTUGAGGGUTGGUGTGUURGGGUAUUATUXGUAUAUTGUUUUTUUTUU<br>TGTURGGUTARGUUUAGGGUUGAGUGARGGUGGUGGUAAGUGUUUGUUUTUAGGGU<br>AGRGAGGUUUTUTGUUUTGAUAGUAGUAGGGAUUUUUUAUGGUUAUUAGUAAUUU<br>UAGTGGGRGGAGGRGUUUT |
| 332 | AGGAGRGUUUTURGUUUAUUGGGGTUAUUTGGUTGGGUUAUGAAGGAGUUUUTGUTGUTG<br>TUAGAAUAGAAGAUUUTRGUTGUUUUTGAGGAUAAGUAUUUTGUUAUUAURGUUAUUTU<br>AGUUUUTGGGRGUAGURGGAUAGGAGGAGAGUUAGUGAUGXGGAUGGGUAUURGGGU<br>AUAUUAGUUUUUTAGAGAUUTGAGUUUTUUTGGUUARGUGGAAUUTRGAAUURGAG<br>UUUUTGUAGAAGUTGGUUUUTGGAGAUUGAGGGUUUUUTGGAUAUUUUUUTATGGAGAUU<br>RGGGGAGUTAGGAUGGGGAAUUT |
| 333 | TUUTTUUTTUTTTUUTTUTTTUTTTUUTTUUUTTUTUUTTTUTTTTUTTTTUU<br>UAUTTTGAGARGUAUUTGGUTUUTGTRGUUUAGGUTGGAGRGUAAUTGGRGUUUAUT<br>RGGRGUAUTGUAAUUTUUAUUTUURGGGUUUAAGXGATTUUTAUTGUUUTUAGUUTUU<br>RGAGUAGUUTGGGAUUAUAGGRGRGUAUUAUUUUAAGUUURGGUUTAAUTTTTTTTTGUATTT<br>TTTAGTAGAGAUUTGGGUUUUARGAUGUUGGURGGGUUTGGUUTGGAAGUUTTGAUUTTU<br>AAGRGUTGRGUUUTU |
| 334 | GAGGGRGUARGUUTGAGGTUAAGAUUTUUAGAUUAGUURGGUUAAUUATRGTGAAA<br>UUUAGTUTUTAUTAAAAAUAUAAAAAAAAATTAGURGGGUUTTGGUAGTGRGRGUUT<br>GTAGTUUUAGUTAUTRGGGAGGUTGAGGUAGTAGAAUXGUUTGAAUURGGGAGGTG<br>GAGGUUTGUAGTGRGURGAGAUGGRGUUAUUTGRGUUTUUAGUUTGGGRGAUAGAGUU<br>AGAGUARGUUTUAAAAUTGAAAGAAGAGAAAAGAAAAGAAAAGAAAAGAGAG<br>AGAAAGAAGGAAAGAAGGAAGGA |

| SEQ ID NO: | Sequence |
|---|---|
| 335 | AGGUUTUTGUTGAUUTGUAGAAUTTGTTGAUURGGATTTTGATGTUAGTUTUAUUGG<br>GUUTGURGTTGUTUTTUTTGGGAUAGAAGAUTUTUTTGAUURGGUUAAUUGGUAGG<br>GUUAGGGGUAUUAGGUUGUGUUUTTGAUGUAGUXGGAGUAUUTURGGUAGUGUT<br>UUGGGUAUAGGUUUTUAUUUARGGGUUUUUTURGUGGRGTTTUARGGGAUUGGAU<br>AGUUTGAUGUUGAGAAGUAUUUAUUUGAUAUAAUGAAUUUUUAUUUGUAG<br>TGGUUAGUUAGGUAUGA |
| 336 | TUATGUUTGAUGAUUAUUGUAAGGUGGAAGGUUUAUUGAUGUAAGUGGGUGUUU<br>UUUGUAGUAUUAAGUGUUUAGUUURGUGAAARGUUUARGGAAGGAGUURGUGG<br>AUGAGGAUUGUAUUAGAGUAUAURGGAAAUAUUXGAUUAUAUAAAGGUAG<br>UAAUUGGAUGUUUUUGAGUUUAURGAAUUGGURGGAUUAAAGAGAUUUUGUU<br>UUAAGAAGAGUAARGGUAGGUUUAAUGAGAUGAUAUAAAAUURGGGUAAUAA<br>GUUUAUAGGUUAGUAGAGGUUT |
| 337 | GGGGRGGGGUUUGGURGGGGGRGGRGGUAGGAUUGAGUAGUUAGGAGGGUUGGGGGAUA<br>GUUAGGUUAGGURGGUGGUAUUURGGURGUUGGAGAGGGUUGGAUGGUARGUGGUAUUAAG<br>UAAAAGGAGGUGAGUUAGAAAGUAGGGAXGGGGUUAGARGAGUAAAGUUGGGUAGGAGG<br>GRGAGUUGGGAGGGGUUGAGURGGUUGTGRGUGGUUUUUTGGGAGGAGGGGGTGUGGUAA<br>GUAAGUUAAAUAGUUGGAGGUUAGUGUAAGGAUAAGAUAGUUGGGUAAARGAGUAG |
| 338 | UTGUTRGTTUGUUUAGGUUGUAUUTGUAUUUGUAUGAUUUURGAAUUGUUUGGUUGUUGGU<br>UAUAUUUUTUUTUUUAAGGGAUUARGUAUAGURGGUUGGUUUUUUAAUUGUUUUUU<br>TGUUUUAGUUUUGUURGUUUAGUUUXGUUUUTGUUUUUTGGUUUUAGUUUUUUUTGUUUGGUGU<br>UARGUGUUAUURGGUUUUUUAGRGGURGGGUUAGUUAUURGGUUUGAUUUGAUUGUUUUUU<br>AGUUUUUUTGGUUGUUAGGUUUTGURGURGUUUURGGURGAAUUURGUUUU |
| 339 | RGAGUUGGGAGGGGUURGAGURGGUUGUGRGUGGUUUUUUGGGAGGAGGGGGUGUGG<br>UUAAGUAAGUUAAAUAGUUGGAGGUUAGUGUAAGGAUAAGAUAGUUGGGUAAA<br>RGAGUAGGGGRGGAGRGUGAGAGUAGAUUGUAURGGAUXGUUAGGUUAGUUUAA<br>GUUGAAGAGGAAGGGGUAAGUUUAGAAGUAGGGGGRGGGGURGAUUAAUUGRUA<br>GAUUTGUUGGGRGAAGAGUAGUAGUUGGGUUAGUUURGAUGUGUGURGGGGUAGG<br>TAGUUTRGGAGGUUGUUUAGGGGU |
| 340 | UUUUUGGGUAGUUUURGAGAUUAUUUGUUURGGUAUAGAUARGGGUUGGUUUAGU<br>TGUUGUUTTUGUUUAGUAGAUTGRGAGGUUGGUUGGUUURGUUUUTGUUUTGG<br>AGUUTGUUUUUTUUTUTUAGUUUGGGUUGGUUGAGXGAUURGGUGUAGUUTGUT<br>UUARGUUURGUUUUGUTRGUUUGUAGGUUGUUUGUUUUGUAUGAUUTURG<br>AAUUGUUUGGUUGUUGGUUAUAUUUUUUTUUUAAGGGAUUARGUAUAGURGG<br>UTRGGUUUUTUUUAAUTRGU |
| 341 | AAUAGGUUUAAGUUUGUGGUAGGUGGGGGUUAUUUAGUUUAGGRGUUUUUAUUU<br>URGGGUUUGGGUUAGAAGUUUAGGAGUUGGUUGRGGGURGGTUUUUUUUAUUUA<br>UTUTGGGAUGUUUAGGUUUGGGUUUUURGUUUAGUUUXGUUAGGUUUUAAUGAG<br>UUTUTGUUTGGUUTGUAGUUAAUUGAURGGUUGGAUUUGGGUAGGUGUTRGAGGA<br>GUUUUAUGAGGGAGGGUAGGUUTUUTGURGUAUUGUUUAGUAUAUAGGAAAT<br>TTAGUAUTTUTGUUUAUUUAGU |
| 342 | GUTGGGUGGGUAGAAAUGUUAAAUTUUTGUAUGUGUGGAUAGUARGUAUAAGAG<br>AUUTGUUUUUUTUAGUGGGGUUUUTRGAGUAUUTGUUUUAAGUUUAAUGGUUA<br>AUUGAUUAUAGGUUAAAUAGAGGUUAUUGGGGUUUGGXGAGGUUAAGGRGGAAA<br>UUUAGGUUUUGAGGUAUUUUAGAGUUGGGUGGGGGAGAAURGGUUURGUAGUUAGUT<br>UUTGGGUUTUTGGUUUAGGUURGGGGGUUGGGGAAGRGUUGGGGUUGGUGAUUUUU<br>AUUTGUUAUAGGUUUGGGUUTGUU |
| 343 | UUTGAUUUAUUUAAUTUUUUAGGGGARGUGGGGGUAUGGAGUUUUAUAURGUA<br>GGRGGUAGUUAAUGUAAUURGRGTRGGAGUTTUUUUUURGRGAGRGUGGUAAGGGUT<br>UAGGGAAGUUURGGGUUUUGGGAGGGGGUUUTGURGXGUAUUUGUXUAGGA<br>AURGURGGGUUUTUUTTURGRGGGAAGXGGUUGGGRGAUUUUURGUUUURGUUR<br>GGGUUUUTTGGGGUUUURGGUGUURGGUUAURGUGGGUUGGGGAUUGAAAGUGA<br>TGGGAUUGAAGAUGGGGGUUGGAA |
| 344 | TTUUAGUUUUAUTUTTUAGUUUUAUAUUUAGUUUUUAGUUUUARGGUGGURGGG<br>UAURGGAAAUUUUUAAGAGGUURGGGRGGGGGRGGGGTRGGUUAAGUXGUUTUU<br>RGRGGAAGGAAGGGGUURGRGGTUUUTGXGAUAGGATGXGGGAAGGUUUUUTU<br>UUUUAGGGGUURGGGAUUUUUUUTGAGUUTUGUUARGUURGRGGGGGAGGAAUUTRG<br>ARGRGGGUTGUAUUGAGUUAURGUUUGRGGUGUGGGGUUUAGUGUUUUUARGUUUU<br>UTGGGAGAUUGGGUGGGGUAGG |
| 345 | TATUUAAAUGUGUUUUATAUAAAAUGAAUGUUUUUAGUGUAUGAGGAAGUUUUTUT<br>AUUTAAAGAAAUUUGUGUGUGAAUUTUTTTUGUGAAGAAUGUUTUUUTAAUGGAAUUA<br>GUUAUUAUGAGUUATUTUGUAAAUUUAGGUUUGXGGUTUUGUUUAAGUAAGAUU<br>TGGURGGAGAAGUGAGAUAAAUUAUAGAUGUGRGUUAAUAAAUUAUGAUUAUUAA<br>AGGUAAAAGAGGGAAAGAAAAAAAAAAAAUUGAUURGUGUAUAUGAAURGAAUUGAGU<br>UAGGGGGUUTUUUAUURGGU |

| SEQ ID NO: | Sequence |
|---|---|
| 346 | GURGGTGGAGAUUUUTGAUTUAATTRGGTTUATATAUARGAGTUAATTTTTTTTTT UTTTUUTUTTTTGUUTTTGAGTAATUTGTAATTTATTAGRGAUATUTATAATTTATUT UAUTTUTURGGUUAGAUATTGUTTAGGUAAAAUXGUAAAUUTGAAGTTTGUAGAAA TGAUTUAGTGGTGAUTAATTUUATTAGGAAAGUATTUTTUAUAAAAGAGTTUAUAG UAGGATTTUTTTAAATAGAAAAUTTUUTUAGTGUAUGAAAARGATTUATTTTATAT AAAAUAUAUUGGATA |
| 347 | TGGGAGTTUUAGTTRGGGGGUAGAUUAGTGTTUAGAGTURGGGUTUTGUTAUTUAG RGUURGAGGUAGRGUUTUUUUAUUUAARGGGGGURGTGGUAAUUUUUGAUAUGAT TUATGAUUAUAUAAUAUAUURGGAAAUUTUTUUUAUXGUUUUURGTUTGGGURGT RGUUUURGGUUTGGGAGAUUUAGGTUTUAGAGTUTUGUUUUARGGGRGAUTA GTGUGUUUAGTGGAAAAAUAAUGUUAGUGRGUAUUAAAAUUAGGTGTAAAATTA AUATTTTTTGGAAGUUAUTTT |
| 348 | AAGTGGUUUUUAAAAAATGTTAATTTTAUAUUAATTTTGGTGRGRGGUTGGUATTA TTTTTUUAUTGGGUAGUAUGATGUURGTGGGGUAGAGAUTUTGAGAUUTGGAG TUTUUUAGGURGGGGGRGARGGUUUAGARGGGAGGXGGTGGAGAGAAGTTURGG ATGATTATGTGGUATGATATGUAGGAATGUUARGGUUUUGTTGAATGG GGAGGRGUTGUUTRGGGRGUTGAGTAGAGUURGGAUTUGAAUAUGGUTGU UUURGAATGGAAUUUAT |
| 349 | RGGRGTGUTTUTTGGUAAAUATUTTTGAGGATGURGUTGUAGUATTTGAGTGU TURGAGAUTTGUTGUTUTTTTUUGTGUTGGGUTGUTGAGAGTRGGGUARGTUU TTTTTTGGAGGUTUAUAGGUGGUTGUTUURGUXGUTGGUUUAGUTTGGTGGT UUGGGGUAGRGAGGGUGGUGGUGAATGGGUAATGUGGTGGGGG TGGTGGUTGUTTUTTTAUUUTTUTTGUGUAAGAAARGGARGUU AAUAGGUAUAGTUAGAAG |
| 350 | UTUTGAUTGTGUUGTGGGUARGTGTTUTTGGUAGAUAAAGAAGGGAGTGAAG AGGAAGGUAGAUAUUAUUUAUUAUUAATTGAUUUAATGAAGUAUUUU RGUTGUUUUGGAGUUAAGAUUAUAAGUGGGUUAGXGGRGGGAGAGUAGUR GGUTGTGAAAUUUUAAAGAAGGARGTGUUURGAUUTUAGUAUUUAUAUU AGAGAAGAGUAGAAGGTUTRGGAGUAGUAAGTGGAGRGGUAUUUUAAG GAGATGTTUGUUAAGAAGUARGURG |
| 351 | TGGTUTGUTTAAGTUTAUTGGUUUTGGUAAGTUUAUTTGGTGAUATTTGT GUUTGGTUUGAGGGUGUUUAGATURGRGATTGUTUUGGGAURGGTAGTU UTUUURGGATGUUAGUAAGUTUUUTUUAGTUUAXGUTGUAGTUTUAGT ATGUUTTAAUAGUUAUTAGTUAUUUUTGTGAGTUAGAUUUURGGTUUTGUUAGG UUAAUUGUTTGGGGUUUAGUAGRGGGGGUGGRGAGGUUAGTTTTUTUUAGRGG TTUTAAGURGUTRGAGGGTGG |
| 352 | UAUUUTRGAGRGGUUTAGAAURGUTGGAGAAAAUTGGUUTRGGUUAGUUUURGUTG UTGAGGUUUUAAGUAGGTUGGUUTGGUAGGAURGUGGGUUUAUUAUAUAUUT GAUTAATGGUTGUTGAAGGUATAUTGGAGAUTGUGUAGGXGTGGAGGUTGGAGGGA GUTTGTGGUATRGGGGAGGAAAUTAURGGGTUUUUAGGAUAATRGRGGGATUTGGG GUAGUUUUAAGGAUUUAGGUAUAAGATGUAUUAAGTGGGAUUTGUUAGGGGUU AGGTAGGAUTGAAGUAGAUUAG |
| 353 | AUUGGTRGGUUAUGGUAGUTRGGGGAAGAAGGGRGRGTGGRGRGUUUAUUUA RGGTGUTGAAGAGUAGURGRGURGUUUAGUTRGUAUARGTTGTRGATGUUUAGUAUR GRGUURGURGRGURGUUUUUTGRGUGRGAAGRGTURGGUXGURGUAGGGTAGGGUT UAGRGRGUAGUAGUTGRGRGATUAGTTRGGAUAURGGUTGUUURGGGAAGAGGTU TURGURGUTRGUUAUTGURGUUAGRGURGAGUURGGGGGGGUTGUURGAGGAGGRG GUUARGGUAUUAGGUAGRGAGTGU |
| 354 | GUAUTRGUTGUUTGGTGURGTGGURGUUTUUTRGGGUAGUUUUURGGGUTRGGRGU TGGRGGUAGTGGRGAGRGGRGGAGAUUTUTTUURGGGGUAGURGGTGTURGAAUTG ATRGRGUAGUTGUTGRGRGUTGAGUUUTAUUUTGRGGXGGURGGARGUUTTRGGRGU AGGGGGRGGRGRGGRGGGRGGTGUTGGGUATRGAUAARGTGTGRGAGUTGGRGG RGRGGUTGUTUTTUAGUAURGTGGAGTGGGRGRGUUARGRGUUUTTUTUUURGAG UTGURGGTGGURGAUUAGGT |
| 355 | TGGUAGAGATAUAAATTUUTGATGGUAGAGGAGGGAGAGAGAGTGTGGGTGARGA TGAUAATTGAAUTGAGAUUUAAAGGAGGTAGGGGAGAUAUATGGGRGTUTUTGGG AAGATGGUUUURGGGAAAGUAUAGUUTTAGAUAGGUUUXGAGGUAGGAGUUTGT UTGAUTUAURGGAGGAGUTGGAGGAGGUGAGGTGGUUTAAGTRGATUAAGUAGG GTGGGGAGGAAGAGGRGATGGTGURGTGAGAUUAAGUAGGGUUTGAGGTUTGG GGGGAGAAUUTGGUTTTTAUTUT |
| 356 | GAGTAAAAGUUAAAGTTUTUUUUUUAGAUUUAAGGUUUGUUGGTUUARGGU AUUATRGUUTUTTUUUUUAUUUTGUUAATRGAUTUAGGUUAUUUATGGTT TUUAAGUUUTURGGTGAGTUAGAUAGGUTUUGUUTXGGGGUUGTUUAAAGGUT GTGUTTTUURGGGGAUUATUTTTUAGAGARGUUUATATGTGUTUUUUTAUUTUUTT |

| SEQ ID NO: | Sequence |
|---|---|
| | TGGGTUTUAGTTUAATTGTUATRGTUAUUUAUAUTUTUTUTUUTUUTUTUTGUUAUUA<br>GGAATTTGTATUTUTGUUAG |
| 357 | AGAGGAGGGAGAGAGAGTGTGGGTGARGATGAUAATTGAAUTGAGAUUUAAAGGA<br>GGTAGGGGAGAUAUAUGGGRGTUTUTGGGAAGAUGGUUURGGGAAAGUAUAGUU<br>TTTAGAUAGGUUURGAGGUAGGAGUUTGTUTGAUUAUXGGAGGAGUUTGGAGGA<br>GGUTGAGGTGGUUTAAGTRGATTAAGUAGGGTGGGGAGGGAAGAGGRGATGGTGU<br>RGTGAGAUUAAGUAGGGUUTTGAGGUTUTGGGGGGAGAAUTTTGGUUTTTAUTUTGA<br>GGAAGGTGGGAGUUAUAGAGGUTT |
| 358 | AGUUTUTGTGGUTUUUAUUTTUUTUAUAUTAAAAUUUAAAUUUUUUUUUTTAGGAUU<br>TUAAGGUUUTGUTTGGUTUUARGGUAUUAURGUUTUTTUUTUUUUAUUUTGUTTA<br>ATRGAUUUAGGUUAUUUAGUUTUUTUUAAGUUUTUXGGUGAGUUAGAUAGGUTU<br>UTGUUTRGGGGUUTGTUTAAAGGUTGTGUTTUURGGGGAUUAUUTTUUUAGAGAR<br>GUUUAUAUGTUTUUUUAUUTUUUTTTGGGUTUUAGUUTUAATTGTUATRGTUAUUAU<br>AUTUTUTUTUUUUTUUTG |
| 359 | TGGGRGTUTUTGGGAAGAUGGUUURGGGAAAGUAUAGUUTTTAGAUAGGUUUURG<br>AGGUAGGAGUUTGTUTGAUUAURGGAGGAGUUTGGAGGAGGUTGAGGTGGUUTA<br>AGTRGATTAAGUAGGGTGGGGAGGGAAGAGGRGATGGTGUXGTGAGAUUAAGUAG<br>GGUUTTGAGGTUTGGGGGAGAAUTTTGGUTTTTAUTUTGAGGAAGGTGGGAGUUA<br>UAGAGGUUTUTAGAUAGAAGAAGGAUAAGURGGAUUAGGAUAUUAGGGTGGGGG<br>TATUTGTGGGGATAAAGGGAGAA |
| 360 | TTUTTUUTTTATUUUUUAUAGAUAUUUUUAUUUTGGTAUUUTGAGTURGGUUTGUU<br>UTTUTUTGTUTAGAAGUUTUTGTGGUTUUUAUUTTUUTUAGAGTAAAAGUUAAGA<br>TTUTUUUUUAGAUUUUTAAGGUUUTGUTTGGUTTUAXGGUAUUAUTGGUUUTUUUUUU<br>TTUUUUAUUUTGUTTAATRGAUUTAGGUUAUUUAGUUTUUTUAAGUUUUTURGGT<br>GAGTUAGAUAGGUUTTGUUTRGGGGUUTGUTUAAAGGUTGTGUTTTUURGGGGAU<br>UATUTTUUUAGAGARGUUUA |
| 361 | GGUTTTGTGAAAUUAAUUAGGAAGAATGAAAUAUAGAGUTGGUURGAUAUUUAGU<br>TRGAGGGAGGGGGUGGGAAGUUUTGGAAGUUGGUTGUUUUTAAGUAGGGGGUUA<br>UTUTAGUUUAUAAGGUUAAGUUGGUAGAGGUAGAXGAGGGGAUTUTGXGGUTUAA<br>GTUARGGGUUAGGAGUURGUAGTUTGURGGGUTGGAAAGGTUAGAGURGGUTUTGR<br>GTUTGGUTGRGURGGUAAGAAGUUAUAATTARGUAGGUAAAAGAGUURGGGGATT<br>AGUUTUAGUAUUUTGGGAUUUTGAAT |
| 362 | ATTUAGGGTUUUAGGTGUTGGGGUTAATUUURGGGUTUTTTTGUUTGRGTAATTGTG<br>GUTTUTTGURGGRGUUUTAGARGUAGAGURGGUTUTGAUUTTUUAGUURGGUAG<br>UTGRGGGUTUUTGGUURGUGAUTTGAGUXGUAGAGUTUUUUTXGTUTGUUTUTGUUA<br>AUTTGGUUTTGTGGGUTAGAGTGGUUUUUTGUTTAGGGGUAGUUAAUTTUUAGAAGU<br>TTURGGUUUUUUTUUUTRGAGUTGGGTGTRGGAUUAGUUTGTGUTTUATTUTTUUT<br>GGTTGGTTTUAUAAGUU |
| 363 | AGGUTGAARGGAATTGGGAGUAGAGUUUTGRGGTAGGAUAGAGAUTTRGUAAAGU<br>URGGAGUAUAUAGUAGUAUUURGTUTTUTAAAGGAUAAUTTTGGGAAAAUTUTTGU<br>UTAAUAUTUTGGUAUUAAGGAUAUUTUTGUAUAUUUXGUUTUTGGAUUAUAAGUU<br>UGUAAGUUUUAUURGGGGUAGGGUTTUUTTATUTTGTGUAURGTGGAAGUUUTGTG<br>UUTGUUUAGGGUUTGGUAUUTGTARGUAUUTGAAAAUUTRGTGTGGAGTAAAGAGA<br>GGGGTGATGTGUAAAGGUUTT |
| 364 | AAGGUUTTTGUAUAUUAUUUUTUTUTTTAUTUUAUARGAGGUTTTUAAGTARGTAU<br>AAGTGUUAGGUUUTGGGUAGGUAUAGGGUUTUUARGGTGUAUAGGAAUGAGGAGU<br>UUTGUUURGGATGGGGUUTGUAGGUUTGTAGUUUAGAGXGGGGATGUGAUAGAATG<br>AUUTTAGTGUUAGAAUAUTAGGUAAGAGUUTTUUUAAAATTGTUUTTTAGAAGARG<br>GGGTGUTGUTGTGTGUTURGGGUUTTGRGAAGTUTUTGTUUTAURGUAGGGUUTUTGU<br>TUUUAATTURGTTUAGUUT |
| 365 | AGUUAGGUTAAAUUAGRGTGTUUUAATGAGGGGUUUTGGGUTGAGTGGAGGAAAT<br>GGGTGRGGTGGAGGTGGGTTTGGUTGGGUAUAGRGGGUARGTGTGGGTAAGRGGGT<br>GGGGURGGTTGTGRGGGTGGUUTATUTGGGGUAAGUAGUXGAGGURGAUTGTGTUR<br>GGRGTGTGGUTTGAGUARGGGUAGGTGTUTGGRGGTGAUUUTGUARGTUTGGTGTTT<br>AUUTGGUUUTGGGTUTGAGTGGGURGRGUUTGGUTGUTGGRGGGAUAGTGTGTTA<br>TUTGUUTGRGGARGUTTURGG |
| 366 | URGGAAGRGTURGUAGGUAGAUAAUAUAUGTUURGUUAGUAGUUAUURGKUUUU<br>UARGUAGAUUUAGGGUUAGGUAAAUAUUAGARGTGUAGGGUAURGUUUAGAUAU<br>UTGUURGTGUTUAAUUAUARGURGGAUAUAGTRGGUUTXGGUTGUTTGUUUUAGAT<br>AGGUUAUURGUAUAAURGGUUUUAUURGUUTAUUUAUARGTGUURGUGTGUUUA<br>GUUAAAUUAUUUUAAURGUAUUUAUTTUUTUUAUUTAGUUUAGGGUUUUUTAUTT<br>GGGAUARGUTGGUTTAGUUTGGUT |
| 367 | UUTTGGUTUAGGUTUGGGGAGGGRGTUATGAGUTAUGAGGTGGGRGTTGUAUTTGTU<br>AGUUGTGUAGURGRGUAUUAUATGAGUAGTUTGGRGGUAGRGRGTURGRGTTRGATT |

-continued

| SEQ ID NO: | Sequence |
|---|---|
| | GRGTUTGGUURGUAGGAGGUURGGUUUAGUUUUTUXGUAUUAGGGUUAURGG<br>RGRGRGATAUUUTGGGGRGGGATRGGGGUTRGTGUTUTGUTUURGAAAUUUTTU<br>TUUUTUUAGTUTUAGRGTTUTTUUTUUTUUUTUTATIUTTUAUTTTGGAGTUAUT<br>TUUTUUUUTUUUTUUTTUUU |
| 368 | GGGAAGGAGGGAGGGGAGGAGGTGTAGGTGAAAGTGAAAGGATAGAGGGAGGAGG<br>AAGAARGUTGAGAUTGGAGGGAGAAGGGTTTRGGGAAGUAGAGUARGAGUUURGA<br>TUURGUUUUUAGGGTATRGRGRGURGGTGAUUUTGGTGXGGAAGGGUTGUTGGAUR<br>GGGUUTUUTGRGGGUUAGARGUAATRGAARGRGGARGRGUUURGUUAUAUTAUT<br>RGGTGGTGRGRGGUTGUAUAAUTGAUAAATGUAARGUUUAUUTATGAUUUATGAR<br>GUUUTUUUUAAUUTGAGUUAAGG |
| 369 | UAGGUTGGAGTGUAAUGGRGRGAUTUTRGGUUAUTGUAAUUTUTGUUUUTRGGGUU<br>UAAGUAAUUTTUTUAUUUTTAGUUUUTGAGUAGUUTGGGAUUAUAGGUAUUTGURGU<br>UAUGUURGGUUAATTTTTTAATTTGTTTTTAGTAGAGAXGGGGTTTUAUUAUGUTGGG<br>UUAGGURGGUUAUAAUTTUUTGAUUUAGGUGAUUAUURGUUUTRGGUUUUUAA<br>TTAUAGGTGUUAUAUUAGGATTUUTTGGUAGAUAGGAGUGUUGUAGGGGATGGAAGT<br>GGATAGUAGGAGGUTUTG |
| 370 | UAGAGUUUUUUAUUAUUUTTUUAUUUUUTAUAAUAUAUTTGUGUGUUAAGAAU<br>UUAAUGAUAAUAUUTGUAAUUTGGGAGGURGAGGRGGGUAGAUAUUUGAGAUAG<br>GAGUUGUAGAURGGUUTGGUUAAAUAUGGUGAAAUUUXGUGUUAUUAAAAUAAAT<br>TAAAAAUTTAGURGGGUAUGGRGGUAGGUAUUGUAAUUUAGUAUUAGGAGGU<br>UAAGGUAGAAGAAUTGUTGAAUUGAGAGGUAGAAGUTGUAGUGAGURGAGAURG<br>RGUUAUTGUAUUTUAGUUUG |
| 371 | TGAAUTGAUUTGGGUAGUAUUTUTUAUUTGRGUUTGAUTTGUUAGAUAGUUTGUGA<br>UUTUTUTGUGGGAGAAAAUAUUAAGAAAURGGUUUUTUTGUUGGUUUUUAUUUUGGU<br>UUGGUUTUUUTGUUUTUAUUUTGUAUAUUUAUGUUUXGGAAUUGUUUTUUTUT<br>GAGUUTUUUUAUAGUTGGUURGGUUUARGUTGGUUUUAAAUUTGUUUAUAUAGAGU<br>UUUAAUUUURGGGUUUATGGUUUAUUAGAGGUAGGUGGAGURGGGGUAUUUUUUUA<br>RGTGGGUUUTTGAGGATGGGA |
| 372 | TUUUAAUUUUAAAGGUUUARGUGGGAGGGATGUURGGUUUAGUGUUTUGATGG<br>GUUAUAGGURGGAGGTGGAGGUUUTGATGUGGGUAGAUUAAAGGUUARGTGGGUR<br>GGGUUAAUTGUAGGGAGGUUAGAGGGAGAAGUAGGUUUXGAGGUAUGAGUGUA<br>GGGTGGAGAAUAGGAGAGUUAGGUAGGUGGGGAAUUAGUAGAGGGGURGGUTTU<br>TTGTGTTTUTUUUAUAGAGAGUAUAGAUTGUUAGUAAAUTGUAAGRGUAGGTGG<br>AGAAAUTGUTUUAGGUAUUA |
| 373 | GGGRGGGGUUTGUGRGGTUTGRGGRGRGGAGURGAGTGGGUTGRGGGGATGRGGGG<br>GAUUAGUTGRGTGGGRGGRGGRGURGAGAGUUURGGGAGGRGRGGGGUTGAGRGAG<br>GGUURGRGGGGGGRGUTGGUTGRGUUTTGGUTURGGUUATGXGUUTAUTTUTUTGRGT<br>UTXGUTAGUTGURGTGUTGUTRGURGTGUAUTARGGUTUUAUTUTGGGUAUUUARGR<br>GGUTUTTURGRGGUAUURGURGGUUUAUAGUUUAGRGRGURGUUUUTURGTGTGUT<br>GTTURGUTTRGGGRGTGURGUUT |
| 374 | AGGRGGUARGUUTGGGRGGGUAGUAUARGGAGGGGARUUKUKGUTUUUUTUTUUU<br>URGGRGGGTGURGRGGGAGAURGRGTGGGUAUUUAGATGAGAURGTAGTAUARGG<br>RGAGUAGURGGUAGUAGXGAGARGUAGAGGGAAGTAGGXGUAUAURGGGAGUUAA<br>GRUAGUUAGRGUUUURGRGGGUUUTRGUTUAGUUURGRGUUURGGGGUUTURG<br>GRGURGURGUUUARGUAGUTGGUUUUURGUAUUUURGUAGUUUAUTRGGUUARGR<br>GURGUAGAURGUAUAGGUUURGUUU |
| 375 | AAGTGTAUUTTUAAGGTATGAGGGGUUUAGAGGAUAUUTGUUUAAAAGUAGUGGTT<br>GTGAGAGTGGUTTTGGAGTUAGGUTGAUAGUTUGGAAAUUTUAGGUGRGUTUTGA<br>AGTGURGGUUGUAUGAUUAGUUUUAGUUTGUGUXGUUTRGGUUTTUTTTGUGU<br>AAGTGAGAGUAUUGUTGAUUUUURGGGGUGGRGAGGGGGRGUARGUAGTGAUUT<br>RGUAUGGUGUUGUUAGGUARGUGGUURGUGUTUAUGAUUUUTGAGAGUUUGGA<br>GUAGUUUAAGAAGAUUT |
| 376 | GAGTUUTUUTGGAGUTGUTUUAAAGUUUAAAGAAUAUGAAAUARGGAUUARGT<br>GUUTGGUAGGUAUUAUGRGAGGUUAUGARGUGRGUUUUUUGUUAUUUGGGGG<br>GAUAGUAAUGUUTUAUTGUAUAAAGAAGGURGAAGXGGAAUAUAGGGTUGGAGG<br>GUUGGUUATGUAGURGGUAUUAGAGGAGGUAUUGGAAGUUTUAGAUUGUUAGUU<br>TGAUUUUAAGGUUAUUTAUAAUUAUTGUUTTTGGGAUAGUTGUUUTUGGGUUUU<br>TUATAUUTGAAAATAUAUTTT |
| 377 | TAAUTTTTAAAUAAAAUTTUUAUGAGUAAUTAAAUAUUTTAAAAUGUTUUUUUUAUA<br>AAAGUGAAUUAGUTUAGTUUTGUAGGUUGAAAAUAUAAUAAGGAGGAUURGGGUUG<br>UAGAAAGUAGAGGGUUAUUUAGAURGUGUUTGAGAGAXGGGGAGAAAGUAGUTGT<br>UTGUTGUGUAUUAGAGGUUUUAGGGAUUURGGUAGUAAUUURGUGGRGGGUUAU<br>AUTTGGGAGUTGATTTGUTTTUAGAAUUAUUAGUUAAGUUAUAUAUGAGUUAGGAGUU<br>TGGUUAUUUAUUUAAAGUUUA |

| SEQ ID NO: | Sequence |
|---|---|
| 378 | TGGGUTTTGAATGGATAAUUAGGUTUUTGGUTUATGTGGUTUAGUTGGUGGTTUTGA<br>AAAUAAATAGUTUUUAAGTGTGGUURGUUARGGGGUTTGUTGURGGGGUTUUTAG<br>AGGUUTUTGGTGUAUAGUAGAUAGUTGUTTUTUUUXGTUTUTUAGAUARGGTUTA<br>GGTGGUUUTUTGUTTTUTGUAAUURGGAUUUTUUTTGTTGTATTTTUAGUUTGUAGA<br>AUTGAGUTGATTUAUTTTTATGGAAAAAUAUAUATTTTAAATATTrAGTTGUTUATGGA<br>GAGTTTTGTTTAAAATTA |
| 379 | GUUTUUAGAUURGAAAUUUUUUAUTGAAGUUAUUUUUAGGAGGAGGGGUUTUAUT<br>GGGGUUTUAAGGUAGUAUUAGUAUUUUUGGTGAUAGGUAUAGUAAUUUAUUAGUTU<br>AUTGGUTUTUTAUTGAGAAUUAAGGUAAGURGGGGUUTGUXGAGGGTATGAUAGGU<br>AGGGAGTGATGGGUURGGUUUAGGGUAGGAGGGAGAUAGAAAUGGGUAGGAAGA<br>GGAGGUTGUUUUAGUAGUAUUUTGAGAGGAGGAGUAUUTUTGGGGGAUAUTUT<br>GGARGGUAUUUUUAAGUAUAGUUUU |
| 380 | GGGGUTGUTGUTTGGGGUTGURGUUUAGAGUTGUUURGAAAGGTGUTUUTUUTUTA<br>GAAGTGUTGUTGGGGAUAGUTUUTUTTUUTGUUUAUUTTUTGTUTUUUTUUTGUUU<br>TGGGUURGGGUUUAUUAUTUUUTGUUTGUAUAUUUTXGGUAGGUUUURGGUTTGUUT<br>TGTTUTUAGUAGAGAGAUUAGUGAGUTGAUAAATTGUTGUUUTGUUUAUGGAAAATG<br>UTGAUGUTGUUTTGAGGUUUUUAGUGAGGUUUUUTUUTGGGAAUGGUUUAGUGG<br>GGGAUUURGGGUUTGGAGGU |
| 381 | TGAGAGUAGUUAGAUUARGUAGUGAUUAGGGAAAGUTRGAAAGTGUAGAUGGGUTRG<br>UAAARGTGGAUUTUTAGTTTUTGGGGUTUTGUAGAUTGGGGTURGGUUUAUUAXGTGUTUT<br>UTGAGTTUTUTTTUUUAAGTAUAGAUAUUUTURGGAGARGGAAUAUUTGUUTURGUUTTTA<br>ATTUTTUUUAGGAGUTGRGGAGGAAGGXGTGAGAAUURGGAGUUGGGGUGAUUTGR<br>GGGGGAGGGGAUURGUUUUURGTRGUUUAUAAUUUTGUUTAAUUUAARGUUUUARGGRG<br>GURGUAAAGGRGAUAURGRGT |
| 382 | ARGRGGTGTRGUUTTGRGGURGURGTGGGRGTGGGTUAGGUAGGTGUGGGGRGARG<br>GGGAAGRGAUUUUUTUUUURGUAAGTUAUUURGGGGUTURGGTTUTUAXGUUTTUUT<br>URGUAGUTUUTGGGAAGAAUUUAAAAGGRGGAAUAAUTGUUURGTUTURGGAGGGATUT<br>GUAUUTGGAAAGAGAAUUAGAGAGUAXGTGGTGGURGGUUUUUAUTGUAGAUUU<br>AAAAUUUAGAGAGUUUAARGTTTGRGAAUUUAUTGUAUUUTRGAUUTTUUUTGAUUA<br>UUTARGTGUUTGGGTGUUTUTUTA |
| 383 | AUAAGRGGUUGGAUUTRGAGAGGAUAUAAGAGUARGTUAAGAGUARGTUAAGAG<br>UAUARGGAUAGGUAUTGGUARGURGGUAGGUAUUUGAURGGUAGAAUAGAGUUUG<br>GUUAGGGUTGUUAGAGAAGAGUTRGGGURGUUUAAGUAGUUXGAUUUUUUAGRGGAAA<br>AUUAUTGUUTTGUUTUTUUAUTGUTGAGAGUUAUUUUAUUUAATAAAAUU<br>TTGUAUUUAUTUUUAAAAUUUAUUAUUATGAGAUUUAAUUUAUUUUGGGTAUAUUUAAGGUAG<br>GAAUUURGAGAUAUAGAAAGUUU |
| 384 | GGGUUTUTGTAUTRGGGGUUUTGUUTTGGTGUAURGGGAAGAAUUGGAUTGUTAUG<br>TGGGTIGGAGAAUGAGUTGUAAGGGTTTUATTGAGUTGGAAGUTAGUTUUTUAGUAGAUG<br>GAGGGAGUUAGAAGGUUAGAUGGTTTTURGUTGGAAGTXGGGUTGUTTGGRGGUURGA<br>UUTTUTUTGAUAGGUUUGGUUAAAAUTUTGUTTUTGURGGGTUAAUTGAUUTGURGGRG<br>TGUUAGUTGUUTGUTGURGTGUUGUTGUTTGARGTGUTUTTGARGTGUTUTUTGAGTGUTUT<br>RGAAUUUAAUAURGUTTGT |
| 385 | AUTTGAAGTUAGGAGTTRGTGAAUAGUUTGGUUAAUAUGGUGAAAUUUGTUTUTA<br>UTAAAAAAAGAAAATUAGURGGGTGUGGTGGGRGUUTGUAAUUUAGUAUTTTGG<br>GAGGGUTGAGGTGGGUGGAUAUUUGAAGTUAGGAGTTXGTGAAUAGUUTGAUUAAU<br>ATGGTGAAAUUUGUTUTUAUUAAAAAUAUAAAAATUAGURGGGUTGTGGTGGTGGG<br>TGUUTGUAAUUUAGUUAUUAGGAGAUUGAGGUAGGAGGAUAAUUGAAURGGG<br>GAGGUAGAGGTTGUAGAGAGT |
| 386 | UTUTUTGUAAUUUUTGUUTUUURGGTTUAAGTGAUUUTUUTGUUTUAGUTUUTGA<br>GTAGUTGGGAUUAUAGGUAUUUAUUAUUAUAUURGGGUTAAUTTTTGTGTTTTAGTA<br>GAGAUAGGGUTTUAUUAUTGUTTGAUUAGGUTGUUUAXGAAUUTUTGAUUUAAGTGA<br>TUUAUUUAUTUAGUUTUUUAAAGTGUTGGGGUTAUAGGRGUUUAUUAUUAUURGG<br>UUAAUUTTTTUTUTTTTTUAGTAGAGAUAGGGGTTUAUUAUTGUTTGGUUGUTAAA<br>GAAUUUGAUUUAAGTG |
| 387 | AAAUUTUUUUUTGUUTGUAUUTTUUTTAUAUAAGUUAAUTAUAUAAGUAAUGTUAUAGGTT<br>UAUUUAUUAURGGAAUUTGUUTGUUAGGAUUUGAUUUAGUAGAUGUGAGTUAUA<br>UUAGUAUAUUUTGUTTGGGGUUUAGGUUTGUAUUUXGUUTURGGUUUUUAGUUUUA<br>UTGUUAGUTUUAUAGGTUUTUGGGGUAUAUUAAGGAGGURGTTUTUTLTUUUUTTT<br>TTUTGAAUUAGAUUUUUGAAAAUAAGAUAUUAGGUUTUTGGGGAAAAUTAAUTTTT<br>GUTUAUGAAUUTUGAUUAT |
| 388 | ATGGTUAAATTUAUTUGAGUAAAAUTUAGAUUTUUUUUAGGAAGUUUGAUGUUTTGUTUT<br>GGGGAUUTUAAUTUUAGAAAAAAGGGAGAGAAAARGGUUUTTUTTGGTGUUTUUUAGAG<br>GAUUTTGATGAGUUTAAUAGTGGGGUTGGGGURGGAAGXGGGAUGUAGAUUTGGGU<br>UUUAAUUAAGGAUGATGUTGGTAUGAUTUUAGTUTGUTGAGGGUUAGGUUUTGGUAAGA |

| SEQ ID NO: | Sequence |
|---|---|
| | UAGGUUURGGUGAGUGAAUGAAURGAUGGUAGUAGUAGAUUGUUUAUGUAAGAAA<br>AUGUAGGUAGGAAAAAGAUUU |
| 389 | UAAGGUUUAGGUUUUAGUUUUUUAURGURGUUURGRGUUUUUUUAGGUUURGGAG<br>RGGRGUUUUUUGRGGUUURGAAGGUGGGUGGGAAAGUUUGGGGAGUUURGGUUU<br>UAUAGUUUGURGURGAGAAUUGUUUURGGGGAAUUURGUUXGURGUAARGGAAAAAAUU<br>GGURGGAGUAGAGURGUURGRGGUUURGRGGURGRGGGUGGAAGGUGAAGGURGAG<br>GGAGGUUAGGURGUUUURGRGURGUUGAGRGUUGGRGURGUUUURUUUUUGAGAUGGGUU<br>RGGGUUAUUUGGUUAGUUUU |
| 390 | GAAGUUGGUUAAGUAGUURGAGUUUAUUUAAGAGAAUARGUUAGURGUUAGGAU<br>ARGUAGAAGUAGUUUGAUUUUUUUUURGAUUUUAUUUUUUAUUURGRGAURGRGGAA<br>URGRGGARGALUUGUUURGGUUAGUUUUUURGUARGGXGGARGAAUUUUUURGGGG<br>GUAGUUUUUAARGAUAGGUUGUGAGAGURGGGAUUUUUUAAAUUUUUUAUUUUAU<br>UUURGAGGURGUAGAAAGGRGURGUUURGAGGGUUAGGAGGGRGRGGGRGGGRGGU<br>GGGGAGGUUGGGAUUGGAUUUG |
| 391 | URGAGGGAGUUAGGUUAUAGUUGAUAGGAAGGUAGAAGGUGGUAGGAGGGGAGG<br>UUGRGUUGUAUUUUGGGUUGUUUAGGUUAAUUUGUUAGGUAGGAGGGGAAGUU<br>RGUGUUUAUUUAUUAUGAURGGGAAGAUGAUGGUAGUUAUXGUGGAUUUGAGGAU<br>UUAGAGUAURGUUAGGUAGAGGAUUUGUAUUAGGGUGAAGAGGUGGAUURGGRGU<br>AGRGGUARGUGURGUAGGAAGGUAUGGUURGGUUGGUGUUUGGUUGGUAUUAGGAA<br>GAGUUUGUAGRGUUUUUAGAAUUA |
| 392 | UAGUUUUGGGAARGUUGUAAGUUUUUUUUGAUGUUAGUUAAGUAUUAGURGGAUUA<br>UGUUUUUUUGUGGGGUARGUGURGUURGURGGAUUUUAUUUUUUAUUUUGGUGUAGA<br>UUUUUUUGUUGGGGGGUGUUUGGAUUUUAAAUUUAXGGUGGUGUUAUAUUUUU<br>URGGUUAUGGUAAAGUGGGUARGGGGUUUUUUUUUUGUUGGUAGGUUGGUUUGG<br>GUAAUUUAGAGGUGUAGRGUAAUUUUUUUUUGUUAUUUUUGUUUUUUGUUAG<br>UGUGGUUUGGUUUUUTRGG |
| 393 | AAAUUAUURGGGRGUGGUGGUGGGUGUUGUAAUUUAGUUAUUAGGAGGURGAG<br>GUAGGAGAAURGUUUGAAUUGGGAGGUAGAGUAUAGGUUGUUGGAGGGUUGAAG<br>GUGUAUUUAGUAGAGAUUGGUAUAUAGGAGGUUUGUAAXGUUUUUUAGGAAAUUU<br>UUGGGUUUAGUAAGAGUUUAGUAGGAGGUAGAAUUAUAURGGGUAGGAGUGUUU<br>GGAAAGGUUUAAGGUAAUUUUUUUUAAAGULUUrGGUUUAAUUUUAUAUUGUUAG<br>GUUGUUAAAGGUUAUUUAAAAGUU |
| 394 | AGUUUUUAAAUGGUUUUAAUAGUUUGAUAGUGUAGGGUUGGGUUAGGAUUUGGA<br>GGGAGUUGUUUGAAGUUUUUUAGGUAUUUUUGUUURGGUAUGGUUUUAUUUUUUG<br>UUGAAGUUUAUUUGGAUUAGAGGUUUUUGGGGGUXGUUGUAGGAUUUUUGUAU<br>GUUAGUUUUUGUGGGUGUAUUUUUAAUUUUUUUAAUAAUUUAUGUUUUGUUUUURG<br>GGUUUAAGRGGUUUUUUGUUUURGGUUUUUUGAGUAGUUGGGAUUAUAGGUAUUUA<br>UUAUUARGUUURGGGUAAUUU |
| 395 | AGGAAAAAAUAGUAGUUUAAGAAUGGGGUUUUUUGUUAUAGUAGGAGURGUAUU<br>UAUUUAUAUAUGUUAUGUUUUAUUGUUAGUAAUUAGUUURGGURGGGGRGUGGGU<br>RGGGAAGAGGGUUUUUUGGUGUAGXGGGUUGGRGUGAUUAUAURGURGXGUAU<br>UUGGUUUGGGUUAGGUUAAUAGAUUURGGGUUUAAGGUGGGUUUAGGRGG<br>UUAGGUUUUUUGUGAGGAAUUGGGUUGGGGUAGUGUUAGUUUUUGUUUUU<br>AUUUGGUUAUAGAAGGGGUA |
| 396 | UAUUUUUUUGUGGUUAGGUGAGAAGUAGGGAGUUGGUAUGUUUAAUUUAGAU<br>UUUUAGUAGGGAGGGUUUGGURGUUUGGGUUUAGUUUGAAAUUURGGGAGUUGUU<br>UAAUUAGGUUUAGAGGGUUAGAGUGXGRGGRGGUGAUGAGUUARGUUAAUUXGUU<br>GUAUUAGGAGAUUUUUUUUURGGUUUARGUUUURGGURGAGAGUUGGUUGUGAG<br>UAAUAAGAUAUAAUAUAUAUAAAUAGAUGRGAUUUUGUUGUAAUAGGGAGGUURG<br>AUUUUUGGGUUGUGUGUUUUUUUU |
| 397 | AUUUAGGAAUUUUUUUUUUUUUUUUGAGARGGRGUUUUGUGRGUUUAGGUUGGAG<br>UGUAGUGGRGUAGUUURGUUUAAAUUGUAAGUUURGUUUURGGGUUUAUGUUAUUUU<br>UUUGUUUAGUUUUUUGAGUAGUUGGAAUUAUAGGXGUUUGUUAUUAUAUUURGGU<br>UAAUUUUUUGUAUUUUUAGUAGAGARGGGGUUUAURGUGUUAGUAGGAUGGUUUR<br>GAUUUUUGAUUUURGUGAUUUAUUUAUUUAGUUUUUAAAGUGUGGGAUUAUAG<br>GUUUGAAUUAUUGRGUUU |
| 398 | GGGRGUAGUGGUUUAAGUUUGUAAUUUUAGUAUUUUGAGAGGUUGAGGUGGGUGGA<br>UAARGAGGUUAGGAGAUURGAGAUUAUUUUGGUAAUARGGUGAAAUUURGUUUUUA<br>UUAAAAAUAUAAAAAAUUGGURGGGUGUGGUGGUAGGXGUUUGUAGUUUUAGUUAU<br>UUAAGAGGGUUGAGGUAGGAGAAUGGUAUGAAUURGGGGGRGGAGUUUGUAGUUAG<br>GRGAGAUUGRGUUAUUGUAUUUUAGUUUGGGRGAUAGAGARGURGUUUUAAAAAA<br>AAAAAAAAAAGAAUUUUGGGU |
| 399 | AAAUAUAGUAGGAGAGAAUUUUUUUUGAGAUUUAAGAUAURGUGUUUUUUUUUUUUG<br>GUUUUUAGUUGUUGURGAGUUUUGGAGAAAAUUGGGGUAUUUGAAUAGAGGURGUG |

-continued

| SEQ ID NO: | Sequence |
|---|---|
| | TTTGTUUUTGUTURGGUUTTGTGTTUTUATTUUTGUUAXGUUATUATGGATAATGAA<br>AGTTGAUTGGUTGURGGGGTTTUUTTTUTUTUTGUUUUTGTUATTUUATTTGUUAG<br>GTUTUATGUUTTTTTTGUAUAGAGTTGTTGTGUTTGGGUTUTAATTTGUUAGGUAGT<br>GATAAATTUUAAGAAAA |
| 400 | TTTTUTTGGAATTTATUAUTGUUTGGUAAATTAGAGUUUAAGUAUAAUAAUTUTGT<br>GUAAAAAGGUATGAGAUUTGGUAAATGGAAATGAUAGGGGUAGAGAGAAAGGA<br>AAUUURGGUAGUUAGUAAUTTUATTATUUATGATGGXGTGGUAGGAATGAGAAU<br>AUAAGGURGGAGUAGGGAUAAAUARGGUUTGTUUAGATGUURGATTTTUTUUAG<br>GAUTRGGUAGUAGUTGAGAGGUUAAGGGGGAAGGGUARGGUAUUTAGGUTUUAG<br>AGGAATTUTUTUUTGUTGTATTT |
| 401 | GUUUTGAGAUAUTAAATGGRGGGGGGTGGGGGGAGGAAAGGGAAGGRGGUAGAG<br>UTUUURGAGURGGGAUAGTUAUTTAUTUTAUAGGUAGTGGGGUURGAUAUAGAUA<br>GRGURGUUUURGUUAGUUUTRGUARGUUUTRGGAAGXGUAGGUTUURGGRGU<br>TGRGUTGGAGGGTUUUURGGUAUUUAGUUTUURGTUUUUAGUURGUTGUAUUTU<br>RGGGUUUUUUTTAUUUTTGAGAGGUAURGGGAGUTGTRGRGGGGGGGUUTRGGGA<br>AATTUUURGGAUUUTGTGUUAGGA |
| 402 | TUUTGGUAUAGGGGTURGGGGAATTTUURGAGGUUUUUURGRGAUAAUTUURGGT<br>GUUTUTUAAGGGTAAGGGGGGUURGGAGGTGUAGRGGGUTGGGGARGGGAGGUTG<br>GGGTGURGGGGAAUUUTUUAGRGUAGRGURGGGAGUUTGXGUTTURGAGGGRGTG<br>RGAGGUTGGUTGGRGGGGRGGRGUTGTUTGTGTRGGGUUUUAUTGUUTGTAGAGT<br>AAGTGAUTGTUURGGUTRGGGGAGUTUTGURGUUTUUUTTUUTUUUTRTAUUUU<br>UURGUUATTTAGTGTUTUAGGGU |
| 403 | AUUUAGUAUTGUAGGAGGATGAGUUUUTGUAGGAAGGAATGUTGGUTUTUTGGG<br>GTAGATAAAGAAGGTTUTGGGGAAGGGAAGGGAGGAAUAGGAAUATGGGUTUUUT<br>GUUAGGUTGTUUUAGGTURGGGATGUUATRGGUAAGTGGGXGGGGAUAGGUUTGG<br>GTAGATGAUATGGTAGTGAGTAAGTGGGGAGGUAGGUUAGUAGAGGAGUUAGGUT<br>UAUUTUUXGUUXGUUUAUUTRGGUUAUAGAURGGGAGGGGTRGGAGUAUTGRGTT<br>GGGGTTGATGAGUAGARGAUTGUUA |
| 404 | TGGUAGTRGTUTGUTAUAAUUUUAARGUAGTGUTURGAUUUUTUURGGTUTGTG<br>GURGAGGTGGGXGGGXGGGAGGTGAGUUTGGUTUUTUTGUTGGUUTGUUTUUUUA<br>UTTAUTUAUTAUUATGUAUTAUUUAGGUUTGUUUXGUUUAUUTGURGATGGUA<br>TUURGGAUUTGGGAUAGUUTGGUAGGGAGUUUATGTTUUTGTUUUTUUUTTUUUTT<br>UUUUAGAAUUUUTUTUUATUTAUUUUAGAGAGUUAGUAUTUUTTUUTGUAGGGGUTU<br>ATUUTUUTGUAGTGUTGTGGT |
| 405 | AGGGAAGGGAGGAAUAGGAAUATGGGUTUUUTGUUAGGUTGTUUUAGGTURGGGA<br>TGUUATRGGUAAGTGGGXGGGGAUAGGUUTGGGTAGATGAUATGGTAGTGAGTAA<br>GTGGGGAGGUAGGUUAGUAGAGGAGUUAGGUTUAUUTUUXGUUXGUUUAUUTRGG<br>UUAUAGAURGGGAGGGGTRGGAGUAUTGRGTTGGGGTTGATGAGUAGARGAUTGU<br>UAGGUAGUUATTUAUAGGAAATGGUAUAGARGUAUATTGTUUAGUTAUUUUUUA<br>TUUTUUUTAGGGGUAAAGTGAATG |
| 406 | ATTUAUTTTGUUUUTGAGGGAGGATGGGGGGTAGUTGGAAUAATGTGRGTUTGTGU<br>UATTTUUTGTGAATGGUTGUUTGGUAGTRGTUTGUTAUUAAUUUUAARGUAGTGU<br>TURGAUUUUTUURGGTUTGTGGURGAGGTGGGXGGGXGGGAGGTGAGUUTGGUTU<br>UTUTGTGGUUTGUUTUUUUAUTTAUTUAUTAAUATGTUATUTAUUUAGGGUUTGTU<br>UUXGUUUAUTTGURGATGGUATUURGGAUUTGGGAUAGUUTGGUAGGGAGUUUAT<br>GTTUUTGTTUUTUUUTTUUUTT |
| 407 | GGTTUTAAAUAUAUAAAUUTTTGATGUAUTGGAATTTAUTTAATUUUTAUUAAT<br>TTTTATUAATGGUTUAATATTTGGGGGATTTTUATGGUAATTGUATGAATGTATTAA<br>UTGGUAGGGAGGATTAUAAUAAGAUUAURGGUTXGAGAAAUAGUAGTUTGTTUUT<br>UUATUUUUARGTUTGUATUUAGGUUUTTUUAUAGAGAUTUTAUTTTUTUUTGUAGAT<br>GAUTUATTUAGTGUTUAGGAAUURGGTGUTUTGTGGUUAUTAURGAGAGTGGGATA<br>TTTTUUUUUATTTTATT |
| 408 | AATAAAATGGGGGAAAATATUUUAUTUTRGGTAGTGGUUATAGAGUAUTRGGATTUU<br>TAGAUAUTGAATGAGTUATUTGUAGGAGAAATGAGATUTUTGTGGAAGGGUUTGGA<br>TGUAGARGTGGGGGTGGAGGAAUAGAUTGUTGTTTUTXGAGAURGGTGGTUTTGATG<br>TAATUUTTUUUTGAUUAGTUAATAUAATTUAGTGUAATTAUUATGAAAAUTUUUAAA<br>TATTGAGUUATTGATAAAAATTGUTAGGAAATTAAGGTAAATTUUAGATGUATUAA<br>AGGTTTGTGTGTTTAGAAUU |
| 409 | TTTGGGGGGUAGGGAGGGTTUAGTUUUUTUAGGUUTGGUTGTGTUUUTGUUUUUU<br>AUUUAUAAUTAGGUUUAGGGTTGGGGGGTGUAUAUUAAGGAGGGGUAGGAAGTGT<br>UUAAGAAGUAGAAURGGUTUTGTGTUUUUAGTGGXGGXGGGTGTUTGGGGUAGGA<br>GGAGGUTATUTGATUUUTTUUUUAUTGUUURGGUUATGAUUTUUTUUTUUUTUUU<br>TRGUTUUUTUUUTUUTUUUTUUUTUUUTUUUTUUUTUUUTUUUTUUTUUUUTTTUUTU<br>GGGTAGUUAGUAUUTGGGUTG |

| SEQ ID NO: | Sequence |
|---|---|
| 410 | AGUUUAGGGTGUTGGUTAUUUUAGUUAUGAAGGAGGAGGGAGGGAGGGAGGGAG<br>GGAGGGAGGGAGGGAGGGAGRGAGGGAGGGAGGGAGGAGGUAUGGURGGGGUA<br>GTGGGGAAGGGAUAGAUAGUUUUUUUGUUUUAGAUAUUXGUXGUUAUUGGGG<br>AUAUAGAGURGGUTUTGUTTUTTGGAUAUUUUUGUUUUUUUUGGTGTGUAUUUU<br>UUAAUUUUGGGUUTGAUUGUGGGTGGGGGGUAGGGGAUAUAGUUAGGUUUGAGGG<br>GAUTGAAUUUUUUUGUUUUUUAAAG |
| 411 | UURGUAAGUUTRGUUUUUUAGGGUUTRGUUUUUUUUUUGUAGAGAGUGGUUAA<br>GUTRGTGTTUUAGAGGUTGAAUGAGGAUUUUGUGRGGAAGUURGAUUAUGUUUGAG<br>UTUTGTGGGUAAGAUURGGAGAUAUUGGAAGAUAGAGAXGUAGAUAGGAAAGAGG<br>UUAAGAUAUUGAUAUAGAUAGAUUUAUGUAUUUGAURGGURGAAGAUAGAGUUR<br>GGAUAGUUUUUAUURGUUUUUAGUUUURGRGUUUURGRGUUURGAUUURGGUAA<br>GGUUTGGGAGUUUTUTGAGGGTTA |
| 412 | TAAUUUTUAGAGGUTUUUAGGUUTUGURGGGAGUTRGGGGRGRGGGGRGRGGGGG<br>UTGGGGRGGGTGGGGGUTGUTRGAGGUTUTGUTUUTRGGURGGUTAGGUGUAUGGG<br>UUTGUTUTGUAGTGUTUUTGGUUTUUUTUUGTGUUUGGGTUUUUGUAAGRUTUU<br>URGGGUTUUAUUUAUAGAGUUAAAGAUAAGUAGGGUUURGUAUAAAAUUUAT<br>UAGUUTUTGGAAUARGAGUUUGGUUAUUUUGUAAGGAGGGAGGGRGAGGUUU<br>GGAGGGGRGAGGUUTGRGGG |
| 413 | UAGAUAGGGUUUTUAGAUUUGUURGGAGGGAGGGUUUUGUAUAUUUGUUAARGU<br>UUGUUUGUTGGGAAAGGGGUTGAUGUUGUAAUGAUAGGUUAAAUAGUAAUAGGAU<br>AUUGAUUGGUAUUTGUAAGUUGAGUUUAGUUAGAGAGGXGAGGAGUAUAGGGGA<br>GGGAGGAAAAUUURGGUGUGGAUUUAUUUUAUARGGGUUUAUGGGUGUUUUGGU<br>AGARGGAAUUUAUGGUGUUUUUAUUUUUUUAUUUAAAAUGGGUGUUUUUAUGUGUAU<br>TGTAAAAGTAAUAGAUUUUUA |
| 414 | TGGGAAUUTGUUUAUUUUUAUAUAAAAGGUAUAUUUUUAAAAUGAGAGAGT<br>AAAAGUAUUUAUAAUUUURGUUGUUAGGAGUAUUUAGUGGGURGUGUGGUGAGAT<br>UUUAUAURGGGAUUUUUUUUUUUUUUGUGUUUUTXGUUUUTUTGAGUTGAGUTUA<br>GUTUGUAGAUGUUAGUUAAUGUUUTGUUGUGUTGUUUAAUUUGUUAUUGUAAUAUAGU<br>UUUUUUUUUAGUAAAUAGGGRGUUGGUAGGUAUGUAGGGGUUUUUUTURGGAUAA<br>GUTUGAGGAUUUTGAUUTG |
| 415 | UAUUUGGUTUTRGUGGUTGGGAUAGAUUGUUUUUUUUUTUUUTUUGGGUGUUAGGT<br>AGGUUUUAGAAAAUUAUUUGAUGUUAGUAAGGUUUGGGUUAUUUAUUGGUGGGGAGGGA<br>AGTGGGRGGGTGUUUAGGGAUAGAUGAGURGGGGUAGAXGUGUUUUGAGGUAGUAU<br>AGUUAGGGUTGARGTGGGUAUUUAUGUAUUUUUGGGGGUTTUUAGAGUUGGUTURGGTU<br>URGTTTGUUUAUAUUAAGUAGGUUAGAGUUGGAGAGGGUUAGGGGGRGUTGGGGTUA<br>AGGUAUGUAUUGAUUAGGRGTU |
| 416 | GARGUUTGGUTAGTGUAUGUUUUGAUUUUAGRGUUUUUUGGUUUUUUUTUUAUUUTUGAU<br>UTGUTUGAUGUGGGUUAAAARGGGAUURGGAGUUAGUUUUGAAAGUUUURGAGGUGUAU<br>AAUGUUUARGUUAGUUUUGAUUTGUTGUTGUUUAGGGUAXGUUTUGUUURGGUTUAUUT<br>GUUUUTGGGUAUUURGUUUAUUUUUUUUUAUUAGUGGGUUGGUUAGGUUUUTGUGA<br>UAUUAGGUTGGUUUUTTGGGUUUAUUUTGGUAUUUAGGAGAGAGGAAGGAAGUAAUUTUT<br>GUUUUAGUUAGAGAGAGAGUUAAGUG |
| 417 | AUUAUAUUUGAAUAUAUAGAUAUUUUUUUAGGGUGUGUUGUGUGUGUGAUAUUUUU<br>AAUUUUUUGUUTGUAUUUUAGGGUUUGUUUAGUUUUUUUUGGUTUUUUAGUUUAGU<br>UTGGUTUUUTURGGUUTUUUUUGUUAUUUUUAUUUTUXGUGUGUGUAUAAGUAGGGAU<br>UAGGUAGGGAGAURGGUAGAUGUTGUTUTUTGUUUUGGGGUUTUUUTUUUTUAGTGT<br>TGUTUUUUAUAUUUUARGRGATGUTUUUAAUUAAAUUGUUUAUAUUAGGUUUUUUAGTG<br>GGGAGAGTUAGAAAUAGA |
| 418 | UTAUUUTUUGAUUUUUUUUAUUGAGAAAGUUTGAGUGUGGUAGUUAAUUAAAAGUAUR<br>GRGUGGGTGUGGGAGUAAAUAUUAAGAAAAGAAAUUUUAGGGAUAGAGAGUAGUAT<br>UUGURGGUTUUUUUAUUUGGUUUUUUUGUUTGUAUAUAXGAGAGGUGGGGATGAUA<br>GGGAGGURGGAAGGAUUAGGUTGGGUUGGGGAGUUAGGAAGAGGUTGGGUAGGU<br>UUTGGAAUGUAGAUAGGAAUUUAAAGGUAUUGAGUAUAAUAUAUUUTGGAAAAGGA<br>TGTUTGTATGUUUAAGTGTGGATG |
| 419 | TUUUUAGUUUAUUURGUAGUUAUUUUTUGAUUUAGAAAAGAAUAAUUUAUAGUUGGGUU<br>UAGUAUUURGGGUUAUUUUUTGUAGUUGUUUAUAUAUUUGGUAGUUGGGUUUAUUT<br>TAUGUAAUGUGGAUXGGGUUUUUUUAUAUUTGAAAAUUGXGUTUUTUAUUUUUUAUUUTG<br>AGAUUAGUGUUUUTGUUAGUUUUAUGUUUURGGGAUGAUUUAUUTUUUUUUAGGG<br>TUTUUUTGRGUUUTGGGAGUUUTGGURGAGGGAGUAGUAGGGGUUGAUGGUAGAGR<br>GGGGGGUAGGUUAGAGUUAGUA |
| 420 | GUTGAGUTUUTGAUUTGUUUmGUUTGUUAUUAGUUUUUGUUGUGUUUUTRGGUUAGA<br>GUUUUUAGGARGUAGGGAGAUUUUGGGAGAGUGAGGUUAUUURGGGGUUAUGGAA<br>GUUGGUAGGAGAUAUUUGGUUUAGAGGAGGGAUAGAGAXGUAGAUUUAGAUGUA<br>AGAAGUUXGAUUUAUUAUUGUAUAAGUGGAUUUAGUGUUUAGAUGUGUGGGUAGUT |

| SEQ ID NO: | Sequence |
|---|---|
| | GUAGGGAGTGGUURGGGGTGUUGGGUUUAGUTGUGGTTGUTUUTTTTUTGGGTUAGG<br>AGTGAUTGRGGAGTGGUTGGGAU |
| 421 | UUAAARGRGGUAUARGGGGARGGUUUUTUURGGGGTUAGGUTUAUTGGUTUUTTU<br>UUTTUAGRGUUAUUAGGUAGGAGGGUUAARGGTUAUAUAGGAGGUAUUUTUAUUT<br>GUUTTTGUAUUAGUAAATAAAGTGUAUUUUAUUTTXGTGTGAGXGTRGGUURGGTG<br>AGTUAGUUUTTURGGGUUUTTUUTGUUUUAGGGUAGGGGGRGTGRGUTGAGUUA<br>GAGGUAGAUUTGUAGAAAGGGUUURGAUTGGGUUUTRGGGUAGGGURGGRGUUUAU<br>UAUAUTUTGGGGGUUAGUUATGU |
| 422 | GUAUAGUTGAUUUUUAGAGTGUGGUGGGRGURGGUUUUTGUURGAGGUUUAGTRGG<br>GGUUUUTTUTGUAGAUUTTTAUUUTUGGUUAGRGUARGUUUUUUTGUUUTGAGAAUAG<br>GAAAGGGUURGGAAGGGUUTGAUUUAURGGGURGAXGUUAUAXGAAAATGGGATG<br>UAUUTTATTTGUTGGUGUAAAGGUAGGTGAGGGUGUUUUTUUTGTGUGAURGUUGGUU<br>UUTUUTGUUTGGUGGRGUUGAAGGGAAGGAGGUAGUGAGUUUGAUUURGGGAGGGG<br>URGTUUURGUGTUGURGRGTUTTTGG |
| 423 | GUAGGAAGGGUUUUAGARGAUAUUUUUUAUAGAUAUAUGUUUAGUUUUUUURGGGTGAU<br>UAAAAUAUTUUUAGTAAAGGUAGAUGAGGUUAAGRGAAAAGGGGGGTGGGTGGAAGA<br>AURGGUUTGAGUTUUUAGUUUAUAGAUAUTRGGAUAUTXGTRGGUURGGTAGGUUA<br>GGGGUUUUUTGGUGGUUUAGGUGGUUAGGUURGGUURGGUUUUTUURGUAGUUUGTUUUUA<br>GUUUUAUUUUUUURGUUUAUUUUUUAGGAUUUUUUAUUTUAUUUAUUGAGGAGAUUAAG<br>AUUAUUTGGRGAGAAUUUUUUUUA |
| 424 | GGGAGGGGGUUUUUGUUUAGGUGGUUUTUAATUTUUUUAGTGAAAAUAGGAGUUUUGGGG<br>GGUGGGRGGGGAGGTGGGAGUTGGAGAUAGUTGRGGGAGGGGGURGGGUUTGAU<br>AGUUUGAGGUUAUUAGGAUUUUUTGUUUUAURGGGURGAXGAGTGUTUURGAGUTGUTGUTUT<br>GUGGGUGGAGAUUUAGAGURGGUUUUUUUAUUAUUUUTTTTRGUUUTGGUUUUTAUU<br>TGUUUUUAUTGAGATGAUUUUTGGUUAUUURGGAGGGGGUUGGUAUAUAUGUUUGUGGGGGT<br>GTRGTUTGGGUUUTTUUUUTGUT |
| 425 | AGGTGAGAUAUUTGGAGGUUUGRGGGGUAGUUAGUAAGUAGUGGGAGAGAGUTGUAUATGRGGG<br>GAAGGUGGGAGGRGUUTGUAGGAAAGGTGAGGGGAGAUAUAGUTGAGUTGUGGTGUT<br>GGUUUAGUTGGGGUUUTGRGUUUUTATURGGGUAUTGUTGAXGGUUAUUAAUAGGTTTT<br>AAGTAURGGAAUGAUAUGAUTGGATTTGUAATTTAAUUAGAUUUTTTUTGAUUTGUUTGT<br>TGGGGGAAUAGAUTGUAAUUTUAUAAUAGUAUUTGUUAGUUGAGUAUUAGAUAAAT<br>GATGAAUUTGGGUUUUAGGGA |
| 426 | UUUTGGGUUUAGGUUUAUAUUTGUTUUAAUAUUUUAGUTGAUAGUTGUTGUTGUUGTGAGGT<br>UGAUAGUTUTGUUUUUUAAUAGUUAGUUAGAAGGAUUUAGUUAAAUUAUAAAUUURGA<br>UAUTGUAUUURGGUAUTUAAAAAUUUTGUUUAGUGGUXGUUAUAGUGUUURGGGATAAGG<br>RGUAAGGUUUUAGUTGGUUUAGUAUUAUAGUUUAGUTGUTGUTUUUUAUUTTTUUT<br>GUAARGUUUUUAUUTUUURGUAUTGUAGUTUUTUUUUAUUTGUTAAUUTGUUURGU<br>AAUUTUUAGAUTUUUAUUUTG |
| 427 | TGTGTTAUUUUAGAAAGUAAGGARGUUUUUAAAGAUGUUUAGAGUUAGTGUTUAAAG<br>GGAUGUUUAUTGGUUAGUTUUUAAAURGUGUGAAUURGGAAAATUTGAGAUTGGTGT<br>UAGUTAAUTUUAGAAAGUUTTATTTUGUUAAGGUUUGAGGAXGUAUGUUUUGUGAUAUAGU<br>UUAGGAAGUUUUGAUGAUAUGUUGUUUUAGGUGGUUUGGGUUGUUAGUUTGAUUUUTAUA<br>UAUUTAGGGAGUAUGAGAAUAUAAUUAAGUAUAUUTUGAGAAAUAUAUTRGGUUUTGGT<br>UUAGAAAGGRGGGGAUAAU |
| 428 | GTTGUTULURGUUTTTUUTAGAUUAAAURGAUGUAUUTUUUAAGUGUAUUUAAUUGAUGU<br>UUUAUGUUUUUTAAGUGUAUAAAAUUAAGUUAUAUUUUUAAUUAUUTGGGUAUAUG<br>UUAUAGGAUUUUUUTGAGGUUTGUGUUAUAGGUAUAXGUUUUUAAUUUUTGGUAAAAT<br>AAAUUTUUUAAATUAAUTGAUAUUAGUUUUUAGAUUUUURGGGUUUAUAGRGGUUGGG<br>AUUGAUUAGUUGGGUAUUUUUUTGAAUAUUGUUTUGAAUAUUUUTGGAAGRGUUUTT<br>GUUTUUTGGGGUAAUAUA |
| 429 | TGAGAAUAAUGUUUUGGUAUGRGAGGAGUAUUUAGUAAAUURGUGUUAUAUUUUUAGR<br>GGAGUAAAUUGUUGUUGUUUUUAURGGGUUUUTGGGUUAUUTGAGGUUGUTAUUTATT<br>AAAGUGUGGGUUTGUGAUUAUUAUUAGGUAUUGAAAUXGGUUGUAGUGGUAGUAUUU<br>AGUUUUUAAAGAAAUGAAURGGGGURGGGRGRGGUGGUUUAUAUAUUTGUAAUUUUUAG<br>UAUUTTGGGAGGURGAGGRGGUUGGAUUAGRGAGGUUAAGAGAUAGAGAUUAUUUTG<br>GUUAAUAUGGUGAAAUURG |
| 430 | RGGGUUUUAUUUAUGUUUGGUUAGGAUGGUUUURGAUTGUUUTTGAUUTRGUTGAUUUAUURG<br>UUTRGGUUUUUUAAAGUGUUGGGAUUAUAGGUGUUGAAUUUAUURGRGUUURGGUUURG<br>GUUUAUUTTUUTTAAGGGUGUUGGUUTGUUAUUUAUUAUUAUXGAUUUUAUTGAUUTAGUAAUG<br>AGUUAUAAUUUUAUAUUTTAAUAAAAUAGUAGUUUAGUAAUUUUAAAGUUURGGUGAG<br>AGAUAGUAAUAAUUTGUUURGUUTGGAAUGAUGAGUAARGAUUUTGUUGGUGLTTUUTRG<br>UAUAUUAGAUAUUAUTUTUA |
| 431 | AGGAUGGAGGURGGGGAGGUAGRGURGURGRGGGGGRGGGRGGURGRGURGUAG<br>GRGGUTGGGGUAAGTGGGGTGRGGUUUAARGTGGGGGGUARGGUGUUUUUTGAUUAUU |

-continued

| SEQ ID NO: | Sequence |
|---|---|
| | RGGUAGARGUTGTGURGRGAGUAGAAGTUUTTUUTUAGUXGUUTGTGUUAGGGGG<br>AAGAGUTGUAGTRGGAURGGGTGAGGUUUURGGGGTGGGRGGRGAGRGGGRGGTG<br>GGTUUTURGUTRGUURGARGRGGGGUTGTRGGGUUTGGUTRGUURGUUAGGUTGGG<br>GAUURGGURGGGTUUATTTURGA |
| 432 | TRGGAAATGAAUURGGURGGGTUUUUAGUUTGGRGGGRGAGUUUAGGUURGAUAGU<br>UURGRGTRGGGRGAGRGGAGGAUUUAURGUURGUTRGURGUUUAUURGGGGGUU<br>TUAUURGGTURGAUTGUAGUTUTTUUUUTGGUAUAGGXGGUTGAGGAAGGAUUU<br>TGUTRGRGGUAUAGRGTUTGURGGGTGGTUAGGAAUAURGUGUUUUUARGTTGAG<br>URGUAUUUAUTTGUUUUAGURGUUTGRGGRGRGGURGUURGUUUURGURGGRGGR<br>GUTGUUTUUURGGUUTUUATUUT |
| 433 | TUTAUTGATGRGGAGAURGAGUUUUAGGGUAGUAGAGUUUUAGUUTRGRGUTAUA<br>RGGUTGTGGGRGUTGRGUUUUAGGGUARGGUURGGUUUAGGTRGTGGUUUAUTRGG<br>GAUURGRGGUUAURGGTGRGGTTGARGRGGUARGGGAAGXGGTAGGTGUUAGU<br>AUUTUUTUUTRGTUUTGUTRGTRGATGAUURGGUAUTGGRGUAGATARGGRGTGAG<br>UTTGGURGGGTUAGGRGRGAGUUAGURGATGURGGARGUUUTRGATTRGUTUUU<br>AUAGRGRGTUUTUUTURGUUTUA |
| 434 | TGAGGRGGAGGAGGARGRGUTGTGGGAGRGAATRGAGGGRGTURGGUATRGGUTGG<br>UTRGRGUUUTGAAUURGGUUAAGUUUARGURGUATUTGRGUUAGTGURGGGUATR<br>GARGAGUAGGARGAGGAGGAGGUGUTGAGUAUUTAUXGUTTUURGTGURGRGTUA<br>AURGUAURGGTGAGURGRGGGUUGAGTGGGUUARGAUUTGGGURGGURGTGUU<br>UTGGGGRGUAGRGUUUAUAGURGTGTAGRGRGAAGUTAGGGUTUTGUTGUUUTGG<br>GGUTRGGTUTURGUATUAGTAGA |
| 435 | UTUAUUTTTUUTAGTTTAGAAAAUUUUUAUTGUTUUUUAATGGAGGUTGUUUUA<br>GGAGTGGUUUAGTGGGGUUAAUUAGUTGUUUATGUUAGUAGUTURGGAGTATGUA<br>UAUUUUAUTUTGGUUAAAUUTGUUUUUUAUUAUXGGUUUUATUAAGAAA<br>UAUUGUAGGUTGGAURGGGTUGGGAUGUAGUAAGUTGGUGTGGUTAUTURGAGT<br>GUGUGAUAUAUUUGUAGGGGUUTGUGAGUAGUGGGAGGGUUAGAUAUGUGGAUUU<br>UUAGGGUTGGUGGUUTUUTT |
| 436 | AGGAAGUUAUUAGUUUTGGGAAUUUAUATGUUTGGUUUUUUAUTGUUAUAGGU<br>UUUTGUAGGTGUGUUAUAUAUTRGGAGUAGUUAUAUUAAUTTGUTGUAUUUUAAU<br>URGGTUUAGUUTGUAGATGAATGTTnTUTTAATGGGGUXGTGAATAGAAGAAUAA<br>GTTTGAAUUAGAGTGGAAATGUAUAUAUTURGGAGUTGUTGGAUAGAAUAGUTGG<br>TTGGUUUUAUTGGGUUAUUUUUGGGGUAGUUUUAUUGGGGAAGUAGTGAGGGAUU<br>TTUTAAAUUAGGAAAGGUAGAGA |
| 437 | AARGUTGAUAUUUUURGGGTGUTGAAAAUAGAAUGGUUUUUUAAGAAUUAAU<br>AARGAUAUGUTTUUAGUUARGUUUUUUUUGUTUUTTGUUTAUAGUGUUUGUUAAAT<br>AGGUGUUAGAGGUURGGGTGUAGATGUAGTGGUUUAXGUUAGUTAAUUUUUAGUAU<br>TUTGGGAGGUTGGUGGGGRGGAUUAUUUGAGGGUUAGGGAGUUUAAAGAUUAGUUTGGG<br>UAAUAUGGUGAAAUUUGUTGUTUTAUUTAAAAAUAUAAAAAAUTAGURGGGUGUGGUG<br>GUAUAAAUUUTGUAGTTUUAG |
| 438 | UTGGAAUUAUAGGUUGUGUUAUUAUAUUUGGUUAAUUTTTGTATTTTTAGTAGAG<br>AUAGGGUUUAUUAUAUGUUGUUUAAGUTGGUTUTTAAAUUTUTGUUUUAAGUGAUU<br>RGUUUAUUAGUUUUUUAGAGUTGUGGGAUUAUUGAXGTGAGUUAUUGTAUUTGUA<br>UURGGGUUUTGUUAUUUAUUTTGAUAGAGRGTGUAGUAAGAAUAGGAAGGGAAR<br>GTGGUUGAAAAUAGUATRGTUGUTAGUTAGTTUUTAGGAAGGUUAGUTTUTGUTTTTAGAUA<br>UURGGAAAGAUGUUAGRGTT |
| 439 | GAGGUUUAUUUARGUUUUUAGUUUARGAUATUTGUAGAGATGUUAAAUUUTGGUA<br>GAGGAAUUAGGUUAUGUGUUUAGUUGUTXUUUAUTUUTUUAUTUUUTGUURGG<br>GUUUTGAGUUAGGAGUUAGGUAUAUAGUUGGAUUUAUTUXGUUAAUGUUAUUUAU<br>UUTTGUGUUUAGUAUURGGUUUARGGUAGGTGUUAGTGUTGUAGGUUUAAUAUGUA<br>UUAGGTGUAAGGUAARGAUAUAUUAUAUAUAGGAUAAGGAUGAUUAAAGUAUUUUTGGGG<br>GUUUTUTGRGGUTGUTGUUTUUUA |
| 440 | TGGGAAGGUAGAGURGUAGAAGGGUUUAGAAGGTGUTTTGUAUUUTGUUUTGUGT<br>GGUGUGTRGTTGUUTTGUAUUUAGTAUATGTGGGUUTGUAUAUTGAGUAUUUTGURG<br>TGGGURGGGTGUTGGGUAUAAGGGTGGGTGGUAUUTGGXGGAUGGUUUAGUTGTGT<br>GUUTGGUTUUTGGUTUAGGGUUUGGGUAGGGAGTGGAGGAGTGAGGGAGUAGUTG<br>AAGUAUAUTGGUUTGAGTTUUTUTGUUAGGGTUTUGGUAUUUGUAGAUTATRGTGAG<br>UTGGGGGRGTGGGGTGGGUUTU |
| 441 | GGAGGUAAARGGGAAUURGGUTGGRGGGUTGRGAGURGGUTAGGGARGUTGGGGUU<br>UAGGGUTGUTGGAUAGUUURGUUUUTGUAUUTUTUUUUAUAATTUUUUTGGUGGGT<br>GTURGAAAUAGUUUURGGGUAAUUUUAGGGRGAGGUAGTXGGGAAUUAAUUUUAGU<br>UTTGAAGUAAGAGAUUAGAGGRGTUUAUAGAAGAGGGGUTUTGRGRGTUURGGAUTG<br>GAUAUAGRGUAGAGTUUATTUUAGGGAUAURGUAAUURGUAAGRGAUUUAGGUUR<br>GUTUUAGGGRGGGATURGRGRGGU |

-continued

| SEQ ID NO: | Sequence |
|---|---|
| 442 | GURGRGRGGATUURGUUUTGGAGRGGGUUTGGGTRGUTTGRGGGTTGRGGTGTUUU<br>TGGAATGGAUTUTGRGUTGTGTUUAGTURGGGARGRGUAGAGUUUTUTTTUTGTGGA<br>RGUUTUUXGTUTUTTAUTTUAAGGUTGGGGUUAGUUGGAAUUUTTUUTTTUUGUT<br>TAUURGGGGUUATTTGGAUUUAGGAUUAAGUGAGGGAUGGGGAGAGGUAUAGGGR<br>GGGGUUGUUUAGUAGUUUGGAUUUUUAGRGUUUUUAUGGGUUGAGUUGUUAG<br>URGGGUUUURGUUGUUUUU |
| 443 | UAUGUGUGAGAUGAGAAGGRGUUAGUGUAGUAUUAGAUAGGUUGAGAUGUUA<br>AGUGAAAUGUUAAGGAGGUGGUGAGGUGGUGAGAGUGUAGGGUGUGAGGUU<br>RGGGGAGAGGGUUAGAGUUGUAGUUUAAAUUGGAGGGUUAXGGUAUGUGGAGGUU<br>AAGAAAGUAGAUGGGAUGUUAGGGAGAGAGUAGGGAUGAAGUAGUUAAGAAU<br>UGUAGUAUUUAAUGGAUAGGAAGAGGGGUAGRGAUAGRGAUGAGUUUGAGAAGG<br>AGGGUGUAGUGUUUUUUAAUUUAUGU |
| 444 | AUAUGGUUGGGGAUAUGUAUUUUUUUUUUAGGGUUUAUAGUGGUGUGUUUU<br>UUUUUUTGUUUAUAGAUGUUGAAUUUUUUAGUUGUUUAGUUUAAUAUUUUUU<br>RGGAUAUUUAUAGUGUUUUUGGUUUUUAUAUGUXGUGAUUUUUAAAUUUAAAGU<br>UGUAGUUUGUUUUUUUURGGGUUUAUAGUUUUAGUUUUAAUAUUUUUAU<br>UAUUUUUUUGAUAUUUAUUUGAAUAUUUAGUUUGUUAGUGUGAUAUGGRGU<br>UUUUUUUAUAUUAGUAUAUG |
| 445 | UUUUUAGGUUUUGGUUUUGUUGURGUUGUUGUUUUUUUUAAUAUAUAAGUUUUU<br>UUUUUUAUUUUUAUGUUGUAUAUAGGAAGRGGUAUAUUGUUUUUAAUGUUUG<br>RGUAUGGAGGUAUAUUUUGUUUUUUUGUGUXGUUGUAGRGGGUUUAGGGUUUAUA<br>GAUGGUAGGAUUGUGUUUUAGGUGUGUGUGAGUUAGAGUAGGUAGGAAGUAA<br>AUGUAAUUUAUURGRGGUGAUGAGGAAUGUUAAGGAAGGRGURGUUUUGAUA<br>ARGGUGUGGGUUGGUAA |
| 446 | UUAUUAAUUUAUAURGUUGUAAGGGGGGGRGGUUUTRGUUAAGUAUUUUUAGUUAU<br>RGRGGUGAAGUGUUAUUUGUUUUUGUUUGAUUUGAUUAUAUAGUAGUUGGG<br>GUAUAAGUUUUAUUAUUUGUGGUUUGGGUGGUGGXGGUAUAAAGAGGAGUAG<br>AAAGUGUGUUUGAUGRGUAGGAUAGAAAAAAUAGAGUGAUGUGUUUUUGUGUGU<br>AGAUAUGGAAAGAUAAGGAAGAGGUUAUGAUGUUGGAAAAGAAAAUAAUAGRGG<br>UAAUAGAAAUUAAAAUUGAGGG |
| 447 | UGUUUUUUUUGUGURGUUAGURGGUUUAGGGUUUAUAGAUGGUAGGAUUGUGUUUU<br>UAGGUGUGUGUGAGUUAGAGUUAGGUAGGAAGUAAAUGGUAAUUUAUGRGGGUT<br>GAUGUAGGAAAUGGUUUAAGAAGGRGURGUUUUGAUAAXGGUGUGGGUUGGUAAAA<br>GGAAAUAGURGGGAGGUUUGUAGRGURGGUUGURGUUUAURGUUUAGUUGAUGUGU<br>AUUUGAUUAAGUUAUAAGAGGGUUAGGUUGUGAUUGUURGAGGGAAAAAUUAUU<br>AGAAAAUUAGGUGUUGGGGUT |
| 448 | AGUUUUAGAUAUUUGGUUUUUGUGUGGUUUUUUUUUGGAUAAGUUAUAGGGUUGGU<br>UUUUUGUGAUUAGUUAAAUGUAUAGUUAGAUUAAAARGGUGGRGGUAURGGRGUUG<br>UAGGGUUUURGGUUGUUUUUUUUAUUAAUUUUAUAUXGUUGUAAGGGRGGRGUUT<br>TRGUUAAGUAUUUUUAGUUAURGRGGUGAAGUUGUUAUUUGUUUUUGUUUGAUTU<br>TGAUUUAUAUAGUAGUUGGGGGUAUAAGUUUUAUAUGUGGGUUGGGURGGU<br>UGGRGGUAUAAAGAGGAGUA |
| 449 | UUGUGUUAAGAGUUAUUUUUUAAURGGGUGGGAGGGAGUAGUUUAGGAAUUGU<br>UGAGAGAGUAGAAUUUUAGUUUUAGGGUUUAGAGUAGGAGGUAGGGUGUGRGGUUA<br>AGRGUUGGUURGGAUAGAAGUAGAGUGGGGUUUUGGUUTUXGGGGUAGGAUGUUUUGA<br>UUUAUAUUUUUUGAGGAGAGAAAGUUUAAGUUUUGUUUAAUGUUUUUUUUUUUUUU<br>UUUUAGAAAAAUGUUUAGUGUUUUUURGGGUUUGAAGGGAAUGGUUUUUUUUmGGGGUUUU<br>AUGAUUUUUUUUUGUGUGGG |
| 450 | UUUAUAUAGGAAAGAAUUAUGGGGUUGGGGAGGAGGUUAUUUUUAGGURGGAA<br>GAGUUGAGGUAUUUUUUUGGAAGGGGGAGAUAGAGAUUAGGGUAAAAGAGUUUUAGUU<br>UUUUUUUUUAGGAAAAUUGUGAGUUAGAAAAUAUUUUGUUXGAGAUUAGGGGGUUUAUUU<br>UGUUUUGUURGGGGUUAGRGUUUGURGUAUAUUUUAUUUUUGUGUUUGAGUUUGG<br>AGRGUGAGUUUUGUUUUUUAGUAGUUUUUGAAGUGUUC<br>AGAAGUGGUUUUUGAGUAUAG |
| 451 | TTTTTTTTTTGAGAUAGAGUUURGUUUGUUAUUUAGGUGGAGUGUAGUGGRGTGA<br>TUTRGGUUAUGUAAGUUUAUUUUUURGGGUUUAUGUUAUUUUUUGUUUUAGUT<br>UUUUGAGUAUUGGGAUUAUAGGUAUUAUUAUUAXGUURGGUUAAUUUUUURTTTT<br>TAUUUUUAGUGGAGARGGGGUUUAUUGUGUUAGUUAGGAUGGUUTRGAUUUUUUGA<br>UURGUGAUAGUURGUUUAGUUUUUUAAAGUGUGGAUUAUAGGUGUGAGUUA<br>UUUUAUURGGUUGUUA |
| 452 | AGUAGGURGGGUGAGGUGGUUAUAUUUGUAAUUUUAGUAUUUGGAGGUGAG<br>GRGGGUGAUAAGGAGGUAGGAGAGAUAGAGAUUAUUUUGGUUAAUAUAGUGAAAU<br>UURGUUUUUAUAAAAAAAAAAAAAAAAAUUAGUGGGGXGUGGUGGUGAGUGUUU<br>GUAGUUUUUUAGAUAUUUUAGGAAGUUGAGGUAGGAGAAUGGUUAUGAAUURGGGAGGT |

| SEQ ID NO: | Sequence |
|---|---|
| | GGAGUTTGUAGTGAGURGAGATUARGUUAUTGUAUTUUAGUUTGGGTGAUAGAGR GAGAUTUTGTUTUAAAAAAAAAAU |
| 453 | TTGUUTUTTTTGATTTTTTUTTTGGGUAGGAGTTAGAATGUAAAATAUAGATTUTAT UTGTATAAAGUAUAUAAGAGATGUTTGGGATUTGGTGATGUTGUAURGGAGATTTU AAUUTGTTTTTUAAAGTGATTUUTAGGGAGTGTGAXGATUTUAAUTUTTTTGGAAGT GAUTTGTUAAAUUATGAGUUATGUTGAGTTUAGUAUAAGTAATATGAGGRGAGGUA AGGUAAGTGGGTGAGTAAGGAGGAAGUAGUUUAGATGAGURGGUAGAGTGUUUAU TGGGAGTGAGGUATGATG |
| 454 | ATUATGUUTUAUTUUUAGTGGGUAUTUTGURGGUTAUTGGGUTGUUTUUTUUTT AUTUAUUUAUUGUUTGUUTRGUUTUAUATTAUUTGTGUTGAAUUAGUATGGUTU ATGGTTTGAUAAGTUAUTUUUAAAAGAGTTGAGATXGTUAUAUUUUUAGGAAUA UUTTGAAAAAUAGGTTGAAAUTUURGGTGUAGUATUAUUAGAUUUUAAGUATUTUT TGTGTGUTTUATAUAGATAGAAUTUTGTATTTUGUATTUTAAUTUUTGUUUAAAGAAA AAAATUAAAAGAGGUAAU |
| 455 | AUAAGAGATGUTTGGGATUTGGTGATGUTGUAURGGAGATTUUAAUUTGTTTTUAA AGTGATTUUTAGGGAGTGTGARGATUTUAAUTUTTTTGGAAGTGAUTUGTUAAAUUA TGAGUUATGUTGAGTTUAGUAUAAGTAATATGAGGXGAGGUAAGGUAAGTGGGTG AGTAAGGAGGAAGUAGUUUAGATGAGURGGUAGAGTGUUUAUTGGGAGTGAGGUA TGATGAGGATTAUTRGTRGTGGGAGGUATGAGGGUAUTUTGTGUAAGGUTUUTTG UAUAUUAAAATGAGGUAU |
| 456 | TGAUUTUATTTTGGTGATGUAAGGAAUUTTGUUAGAGAGTGUUUTAUTGUUTUUUA RGARGAGTAATUTTTUATUATGUUTUAUTUUUAGTGGGUAUTUTGURGGUTUATUTG GGUTGUUTUUTUUTTAUTUAUUUAUTTGUUTTGUUTXGUUTUATATTAUTTGTGUTG AAUTUAGUATGGUTUATGGUTTTGAUAAGTUAUTUUUAAAAGAGTTGAGATRGTUAU AUTUUUTAGGAATUAUTTTGAAAAAUAGGTTGAAAUTUURGGTGUAGUATUAUUAG AUUUUAAGUATUTUTTGTG |
| 457 | AGUAAAUAGAGGGTATGGTUUAAUTTGUUATGAAURGGGAAGUATAAUAUUUAA TATTTGTGUUTUAAGUAGTUGUTTUATTTUAAAAGUAUAGGAAAUUUGTGUTTUUUU TGUUAUAAAATUUUAUAAAGUATUTGGAAAGATUTUXGUAGGUUAGUAGGUUUUAA AGTGGGTUUUUAGAAUUAGUAAUAGUTGAAUUAURGGGAAUTGGUUAGAAATGUA AAGTUUTRGURGUUAUUUUTUAAUUUUUUAGAUUUAATGAAUUAGAAAUTUTGGGG TGTGGUUUAGTGGUUTGRG |
| 458 | RGUAGGUUUAUTGGGUUAUAUUUAGAATTTUTGGTTUATTAGGTUTGGGGGGTTGA GGGGTGGRGGRGAGAUTTUGUATTTUTAAUUAGTTUURGGATGATTUAGUTGTUGUT AGTTUTGGGAATRUAUTTTGAAAAUUAUTGGUUTGXGGAGATUTTUUAUTAUUTT TGTAAGATTTTATAAAUAAGAAAAAAGAUAGGATTUUUTGTGUTTTUAAGTAAAAUA AUTGUUUAAGGUAUAAAUAUAUUAAAATAUTATGUTUURGGTTUUATAGGUAAGTUGGA UUAUAUUUTUTGTTTGUT |
| 459 | GUUUTAUUURGUTUTUTURGAUTUUUURGGGUURGGUUTGRGUUTTUUTGRGGTGU RGAGGAGRGGTGGRGUUUTGGGTGAAGAAGTUURGURGAGTRGAGGGGRGUAATG GAGGAGRGURGGAAUAGGTUTUTUATTURGAGTAGUTAUXGTTGUAUTGTGRGAGT GTAAAAGTUAAUTUUUAUURGGTUTUAGTTGTTTUUAAAUUTUAGTTGAAGTGAGGAGG TTGGAUTGGAAGGTTTUTGGGGTAUTUUAGTGAGGUTGGGGTTUAGTUUUAAUTU TUAAURGTGGUAUUUUAAAGGU |
| 460 | GUUUTTGGGGTGUUARGGTGAGATTGGGAUTAGAAUUUUAGUUUAUTGGAGTGAU UUUUAGAAAUUTUUAGTUUAAAUTUUTUAUTTUAAAUTGAGGTTGGAAUAAUTGAGA URGGGTGGAAGTGAUTTTUAUAUTRGUAUAGTGUAAXGGTAUGTAUTRGGAAUGAG AGAAUUTGTTURGGRGUUTUUTUATTGRGUUUUTRGAUTRGGRGGGAUTUTTTAUU UAGGGRGUUAURGUTUUTRGGUAURGUAGGAAGGRGUAGGURGGGUURGGGGAG TRGGGGAGAGRGGGGTAGGGU |
| 461 | GGAUAUAAUUTUTGTTUTTUAAAGTTGGUAUAAGAGUTUUUUTGRGGTUUUUUTT UUTUTUUTRGAGUAGUAAAGGRGTGGUUUAUAATGUUUAUUUTGTGGGUUAGGG GTGUURGGUTUGTGAUUTUUAGGUUUUUUTGTGGXGAGGTTTGGAUTGUATAUA TGGTGUAGGUUUUUAUAUTGGAGUTGUUAGGAUAGUAUTGGAGAUUUUAAGUU AAUAUUTATTTTTGGUAAUAATTAUAAGUATTTGUAAAAGUURGGGGATGUTGGUA AATUTTTTTAAAATAAGAG |
| 462 | UTUTTATTTTAAAAAGATTTGUUAGUAUAUURGGGUUTTTAUAAATGUTTGATAATT ATTGUUAAAAATAGGTATTGGUUTAGGGTUTUUAGTGUTGUUTGGUAGUTUUAGT GATGAGGGGUUTGUAUUATGTATGUAGTUUAAAUUTXGUUAUAGAGGGGGUUTGG AGGTUAGUAAGURGGGUAUUUUTAGAUUUUAUAGGGTGGGUATTGTGGAUUARGU UTTTGUTGUTRGAGGAGAGGAAGGGGAAURGUAGGAGGAGUTUTTAGTGUUAAUTT TGAAGAAUAGAGATTGTGTUU |
| 463 | AUTTGAGRGUTTUTUUAUUUUAGUAGGUURGUTGUUAUAAGGGUUAUUUTGTGG GUTGUUUARGUTGUTGUTAAUUAGTGAUUAUAAGUTURGTGGTGUUGAGAAGUAUAT |

| SEQ ID NO: | Sequence |
|---|---|
| | GTTTUTUUTUUUARGGUTGTGTAGGTURGGAGTUUTAXGGGUTUAGUUAGUUUUUU<br>TGUTUUAGGUTUAAUUAGGURGGAAUAAGAUGUUAGGGUUTGGUTGUTGUTUUGGA<br>GGUTUTUGGUGAGAAUUTGUUTGGUUGGUGAGGGUGTGGUAGAAUUURGAUG<br>UTUGAGUUUGAAUGGUGAAA |
| 464 | TTTUAUUATTUAAAUTUAAGUATRGGGATTUTGUUAUAUUUUUGUAUUAGGUUAGAA<br>GUAGGUUUTUAUUAAGAGUUUUUAAAGUAUAGUUAGGUUUTGGUAUUTTGAUUR<br>GGUUTGGUUAAAUUTGGAGUAGGGGGAUUGGUGAGUUXGUAGGAUURGGAUUT<br>AUAUAGURGUGGGAGGAGAAAAAUAUGUGUUUTUAAUAUUARGGAGUUTGUGGUAU<br>TGGUUAUAGUAGRGUGGGUAGUUUAUAGGGUAAGUUUUTGAUGGUAGRGGGUUTG<br>UTGGGGUGGAGAAGRGUTUAAGT |
| 465 | AAAUTAARGUTGGUUUUAAGAGGAGGAAUAGAGAAGUUTUUTGGUTGAGGUUUAGU<br>RGAUTGUTGAUURGGAAAAGUUUUTRGAGGUGAUUTAUAUUUUUAGUUTUTGUAUA<br>TGUGGGUGAGUUAGUUGUAGUTUTGUUUXGUGAUUGAGUAXGGGAXGURGGAGGT<br>ATTUAUTAAGGUATGAGGUTATUTGUUTAUTUUUUUAUGUGUUAGURGAGUGAURGAA<br>TUTUAGUUUUUTAGUUUUTAUAUUUUTAGGGUUUAGUGGAUUGUAAGUGGUGAU<br>AAGAGUTGUTGUTGUUUUUAUT |
| 466 | GTGAGGGUAGUAUAAUUTTUAUUAGUUUAUAGUUUAUAGGAUUTAGGGAUG<br>TAGGGGUUAAGGGAUUGAGAUURGGUUAUURGGUGAUAUAUGGGAAGUAGGUAGA<br>TAAUUUAUGUUUUGAUGAAUAUUUURGGXGUUUXGUGUUAGUAXGGGAAUAGAG<br>UTAUAAUTGGUUAUUUAUAUGUGUAGAGGUTGGGGAUGUGAGUUAUUTRGAGAA<br>AUTTTTTRGGGUUAGUAGUAGGUUTGGGUUUUAGUUAGGAAGUUTUUTGUUUTUU<br>TUTTGGGUUAGRGUTGAGUUTT |
| 467 | AUTTGAGRGUUTUTUUAUUUUAGUAGGUUURGUTGUUAUAAGGGUUUAUUUTGUGG<br>GUTGUUUARGUTGUTGUAAUUAGUTGAUUAUAAGUTURGUGGUGUUGAGAAGUAUAU<br>GUUUUTUUTUUAGGUGTGUGTAGGUUURGGAGUUUAXGGGUTUAGUUAGUUUUUU<br>TGUTUUAGGUTUAAUUAGGURGGAAUAAGAUGUUAGGGUUTGGUTGUTGUTUUGGA<br>GGUTUTUGGUGAGAAUUTGUUTGGUUGGUGAGGGUGTGGUAGAAUUURGAUG<br>UTUGAGUUUGAAUGGUGAAA |
| 468 | TTTUAUUATUAAAUTUAAGUATRGGGATTUTGUUAUAUUUUUGUAUUAGGUUAGAA<br>GUAGGUUUUTUAUUAAGAGUUUUUAAAGUAUAGUUAGGUUUTGGUAUUTTGAUUR<br>GGUUTGGUUAAAUUTGGAGUAGGGGGAUUGGUGAGUUXGUAGGAUURGGAUUT<br>AUAUAGURGUGGGAGGAGAAAAAUAUGUGUUUTUAAUAUUARGGAGUUGUGGUAU<br>TGGUUAUAGUAGRGUGGGUAGUUUAUAGGGUAAGUUUUTGAUGGUAGRGGGUUTG<br>UTGGGGUGGAGAAGRGUTUAAGT |
| 469 | GRGAATAAAAAGUUAGUGUGUGAGUAAGUTUTGUGGGAAGAUGUAUGUAGAGUGUGA<br>UAGAGAGUUTAGGGGUTRGUGUGAUAAUURGUGGAAAUGUUUUTAAAGGRGAGGGT<br>ATGUGUGUGGGUGUGAGGAUURGGUTGUUGGAUGUUUAXGUAUUTTATTAGUTAGAT<br>ARGGGAGUUAAUAUUUAAUUGUAGUGUAUUAAAAUAUUAUUAGGUGGGUAUGAUUUTG<br>AGGGAAUGAGGGAAGGGAGAUAAGGUUTGGUGAGAUUAUUUGUGGGAUUAUUGUG<br>TGUAUUUGUTGGUUUGUA |
| 470 | TAUAAAUUAGUAAAUAUAUAUAGAUAAUUUUAUAGAUGAUUTTAUUUAGAUUUTGUT<br>TTTUUUTUUTTTUATTUUUUTUAAAAUUAUAUUUAUUUAAUAAUGUUUUAAGGU<br>AATUGAGUAUUAGUUUURGUAUUUAGUUAAUAAAAUAXGUAAAUAUUAAUAGURG<br>GGUUUTUAUAUUUAUAUAUAUAUUUUTRGUUUUTUAGAAAAUAUUUUUARGGAUUGUUA<br>UARGAGUUUUUTAAAUUTUUTUTGUAUAUUUUUGAUGUAUUUUUUUAUAGAUUUTGUUU<br>AUAUAUUGGUUTUUTATTRGU |
| 471 | UAGUGAGUTGAGAGUAAGRGUUAUUUGUAUUUUUAGUUUTGGGGGAUAGAGUUGAGAUTUT<br>GUUUUAAAAAAGAAAAAAAGAAUUGAUUUUUAAAUGUGUGGGGAGAUUGAUUTTUAG<br>TAATAAUAAAAUUUGRGUUUTUUUAUAUAGUUAGUUUUTGXGUGAAUUUUUTUTTUUU<br>TATUTGRGAUUUUUUTGAUUTGAGUUGAUAGUAAAAUTURGGUTUTUUUTGUAUAGUUAG<br>UTUTGRGUGAGUUAUUTUTUTUUUUTGUAAUUUUUTGUAUUGAUUAUUA<br>GUTUGGGUAGUAGGGUUAAGGT |
| 472 | AUUTUGUUTGUTGUUUAGAUAGAGUTGAUGGAUAAGAUAGGGGAAUUAUAGGGG<br>AGAAAGAAUUGAUUAARGUAGAGUUGGUTGUGUAGGAGAAUURGGAGUTTTAUTGUUAUU<br>TUAAAUAGGGGAAUUGUAAUAGGGAAAGAGGGGAUUUAXGUAGAGUUGGUTGTGT<br>GGGAGAAUURGGAGUUUTTATTAUUTGAAAAUUAGUTUUUUUAUAUAUUTGGGAUUAGU<br>TUUTUUTUUTUTUUTUUUUGAUUAGAGAGUTUAUUTUAUUUUUUUUAGGUTGGAGUGUAGT<br>GGRGUTGUTUTUAGUTTAAUTG |
| 473 | GGATGUTRGGTGUTGUUUAAUUUUUAGUTUUAUUUUAUUGTUAAAGUUTAAGUTUTUUUU<br>TUUUUURGUUAAGUGUAUGAUUTTGAGUTUUUTGUGUUTUAUTGUUUUUAUUTGUUA<br>AGTUGAAAUGUUUUUAGUUUUUUAUUUTURGGGAGUUGXGUGGGAGGUAUAUAUGAA<br>UAUUAGGAAGUGAGUUUAUTGUAGUURGGGUUAGGGAUURGGUTUTUTGUUUTUGU<br>UUTAAUUUUUARGGUUUTGGGGGAAARGUTUAGGGGUGAGGAAGRGUAGUUUUTUUT<br>TGGAAUTUAGRGGAAGUUUU |

-continued

| SEQ ID NO: | Sequence |
|---|---|
| 474 | GGAGUUTURGUTGAGAUUUUAAGGAGAGGUTGRGUTUUTUAGUUUTGUARGTTUU UUUAGGURGTGGGGAUUAGGGUAGAGGUAGAGAURGGAGUUUUTGGUURGGGUTG UAUAAAUUAUUUUUUTGGUTGUUUAUGUGUGUUUUUUAXGUAAUUURGGAGGUGG GGAUTGGGAGUAUUUUUAUUUGAUAGAUGAGGAUAGUGAGGUAUAAAGAAUUAA GGUUAUAUAGUUAARGGGGGAGGGGAGAGUUAAGUnUAGUAGUGGGGUGGAGU UGGGGUUGGUAUAUURGAUAUUU |
| 475 | TAAUUGAAUAUAUAAUUUAUUUUUAUUAUUUGAGUUUURGGUUAGGUUUUUGAG UAUUARGAAUAGGAAUGAUUAUGUUUAUUUAUUUUUTRGUUAGUUAAAGAUUGU UAGGAGGUURGGGGUUGUGGUAUUUAARGUUAUAGAXGUAAGGUUUUUUUGUUUAU UUAGUAUUUUAAAUAUUUUAUGAUAUAUGAAGGUUUUGAUAUUGUAAAURGGAUUA RGAUAAGUUUUUGAUUUUURGGGGUUGUGAGGAGUUUUAGAAAAUAAUUGAGAAGU AAUUUUUUUGAGGAUGAUG |
| 476 | UAUUAUUUUUUAAAAAAGUUGUUTUTUAGUUAUUUUUAAAAUUUUUAUAAUURGGA GAAGUUAAAGGUUUGUTRGUAGUURGGUUUGUAAUGUUAGAGUUUUAUAUGUUAUGA AAUAUUUGGAGUGUUGGGUGGGUAGGAGGGUUUUAXGUUUGUAARGUUGAAUAUUA UAAUUUURGGGGUUUUUGGUAGUUUUUGAUUAGRGAAGGGUGAAGUGGAGUAUAGUU AUUUUTGAUUGRUTGGGUAUUUAAAGAGUUUAAGUURGGGGAAUUUAGAUAAUGGAAAATG AAUUAUGUGAUUUAAUUA |
| 477 | UAAUAUUUUTGUAUUUAGUAUUUUUUGUAUUGUAUUUAUAGAUGUUUUAUUAA AGUGAUGGUUAAUUUUUAUUUUTRGAAUURGGGUUUUGGUAAAUGGGAUGUUAAU AAUAGUUUUUAAAUAGAGGGAUAUAUAGUAUUUGXGUUGAGUUUAUUUUUUUUUAT GUUUUUAAGUAUGUUAUGAGAAUAXGUUUGGGUUAGUUGUGUGAAGGAGUGAGU UGAGUUAUUURGGUUGAUAGUUAGUUGAUUUUUAGUAGUUGAGAGGUAUUUUAUAA AGUUGUUTUTGUUGAUUAUU |
| 478 | GUGGUUAGUAGAGUAGUUUTGUGGGGUGUUUUAUUGUUAAGAGUUAGUUGGUU GUUAUGGGAUGAUUAGUUUAGUUUUUUAGUAGGUUGAUUUAGGXGUGUUUUUA UGGUAUGUUGAAGAAUAUAAGAGGGGAGUGGGGUUAXGUAAGUAUUAUGUGAUUU UUUGUUUGGGAGUGUUGUUAAUAUUUUAUUUGUUAAAGUUURGGAUUUGAAGGGUAA GGAAAUUGGUUAUAUUUUAGUGAGAGUAUAUAGAAUGAUAUGGUAAAGGAUGU UGGAUAUAAGGAAUGUUGU |
| 479 | GUUTUTUAUAAAGUGAUGGUUAAUUUUUUAUUUUTRGAAUURGGGUUUUGGUAAAAT GGGAUGUUAAUAAUAGUUUUUAAAUAGAGGGAUAUAUAGUAUUUGXGUGAGUUUA UUUUUUUUTUUAUGUUUUUAAGUAUGUUAUGAGAAUAXGUUUGGGUUAGUUUGUGG AAGGAGUUGAGUUGAGUUAUUURGGUUGAUAGUUUAGUGUAUUUUUAGUAGUUGAGAG GUAUUUUUAUAAAGUUGUTUTGUGUAUUUUUUAGAAUAURGAGAUAAAAGAAATG UUUAUUUAUUAUAUGUAAUGAG |
| 480 | TUAGUGAUAUGUAAUGGUAAAUAUUUUUUUTGUTRGUGUUGUUUGGGGUGGUUAGUAG AGUAGUUUTGUGGGGUGUUUUAUUGUUAAGAGUUAGUUGGUUGUUAUURGGGAU GAUUAGUUUAGUUUUUUAGUAGGUUGAUUUAGGXGUGUUUUUAUGGUAUGUUUG AAGAAUAUAAGAGGGGAGUGGGGUUAXGUAAGUAUUAUGUGAUUUUUGUUUGGGA GUGUUGUUAAUAUUUUAUUUGUUAAAGUUURGGAUUUGAAGGGUAAGGAAAUUGGU UAUAUUUUAGUGAGAGUA |
| 481 | UUUUUAGUUAAAUUAUTRGAUUGUUUUUUAUAUUUAUAUGGURGUUUUUUUUTGG AGUUGUAUUUAAUAGUGGUAAUAUUUGUGGUURGAGUUUUUUUUUAGUUGGUU AGUUGGUUUAGUGAGUAUGAUUAAUUUAURGGGUUUUUTXGUUUTUAGUAUUAUUTU UAGRGGUUUUUTRGUUUTRGUUTUUUAGAGUUUAUUUUTGAGUUGRGUAGUGUU AUUUAARGAUAGUAGUUUUAUUUAUUUAGRGGUAUUUAUUUUUUUUTARGURGAAUU AUTGAUAUUUUUUUTGAGUUAUA |
| 482 | TGUGGUUUAGGGAAAAUGUUAGUGUUTRGGRGUUGGGGAAGGUGGGUGURGUUGAGUA AAUGGGAUUGUGUURGUUGGAUGGUAUTGRGUAGUUUAGGGGUGGGUUUUTGGGGAA RGGAGGRGGAGGAGGURGUUGGAGAUGGUGUUGAGGAXGAGGAGGURGGUGGGUU GGUUAUGUUAUUAGGUUAUUGAUUAAGUUGAAGAGGGGUUTRGGGUUAUAAGGUG UUGUUAUGUUGGGUGUAGGUUUUAGGGAAAAGRGGUUUAGUAUAGGUGAUGGGGGG UAGURGAGUGGUTUGGUUGGGG |
| 483 | GUAGUGGUTGGGUUUUUAUUUUUUUAGGAAAAUUUAAAAAUUUUUGGGUUAGURGRGGG UGGRGGGUUGGGGUAGGUAUAAAGAGGGUUTUUTGUURGGURGGUTGGGUTGUUUUA UAGGAUUUTGGGGGAGGAGGURGGAGURGGUUUUXGUUURGUUUTGUUUUUTGRGG AGGUUGRGGAAUGUURGGAGUUTUTGGUUUAGUUUGUUURGUUTGGUUUAUUURGUA GUUUUUTUUUUUAUUUUUUTUUAGGGUUUUTGGGGUAUAGUUTT AGGGUUUUTGAGAGUUAUUUUUUA |
| 484 | TGGAGGGUGGUUUTUAGGGUUUUUGUUGUAGAGAAGUUUGUAGUUGUAUUUUUAAGGU UUTGGAAAAGAUGGGGAAGGGGGUTGRGGGUGGGUUAGARGGGGUAGGUUGGGUUA GAGUUURGGGUAUUURGUUAGUUUURGUAGGAAGUAGAAXGGGARGGAAAUURGGUT URGGUUTUUTUUUUUUAGAAUUUUTGUGGGUUAGUUUUAGURGGURGUAUAGAGGGUUUT |

| SEQ ID NO: | Sequence |
|---|---|
| | UTTTGTGUUTGUUUUAAUURGUUAUURGRGGUTGGUUUAGGGUTTTGAGTTUUTG<br>GGGGGTGGGGUUUAGUUAUTGU |
| 485 | AGGUAUURGTUAUAARGUURGGUTAATTTTTTTGTATTTTTTAGTAGAGARGGGGTT<br>TUAURGTGTTAGUUAGGATGGTUTUTAGTUTUUTGAUUTTGTGATUUAUUUAUUTUA<br>GUUTUUUAAAGTGUTGGGATTAUAGATGTGAGUTAUXGUAUURGGUUAAGTTUATG<br>ATUTTTUTGTAUTUTGAGUUAGTGTTAUTGGUAAAGAATGUUUTGGUUATTGTGGTG<br>TGGATGGAAGUUAGGUAUATTGUAUUUATTUUTTUUTAGAUTAAGTTGUUTGGUUT<br>GTGGAUUTTUTUAGUUAG |
| 486 | UTGGUTGAGAAGGTUUAUAGGUUAGGUAAUUTAGTUTAGGAAGGAATGGATGUAA<br>TGTGUUTGGUTTUUAUUAUAUUAUAATGUUUAGGGUAUTTUTTGUUAGUAAUAUT<br>GGUUAGAGUAUAGAAAGATUATGAAUTUGGURGGGTGXGGTAGUUAUAUTGTA<br>ATUUUAGUAUTTUGGGAGGUTGAGGUGGGTGGAUAUAAGGUUAGGAGAUTGAGA<br>UUAUUUGGUUAAUARGGUGAAAUUURGTUTUTAUUAAAAAAUAUAAAAAAAATTAG<br>URGGGRGTTGUGARGGGUTGUUT |
| 487 | TTURGTGGGGATGUAAUUTRGTTUGUUUUUTGAUTUUUUATGAGAUTUTRGUTT<br>UUTUUUAUAUUTUUTTAUUUUUAAUUUUUTGURGGUUUAUUAGGUGUAGUT<br>GGGUTUTGRGGGTAGGGGAUAUUTAGGUUTGAUXGUUAGAGUAUURGGUUAGT<br>UURGGUUAUAGUUUTTGGUUUAAGTGAGGGUTGGUUTGGGGAUAAGUGRAAATA<br>GGGUUUTGGUTGTATUUAGAAAGAGAAUTGAGAUURGUTTGUUTUUUAUTGGGUUA<br>UUUUURGAUUUUAAUUAUATA |
| 488 | ATGTGGTTGGGGTRGGGGGTGGUUUAGTGGGAGGUAARGGGTUTUAGTTUTUTTT<br>UTGGATAUAGUUAGGGUUUTGATTTRGGUTTGTUUUUAGGUUAGUUUTUATTGGG<br>UUAAAGGUTGTGURGGGAUTGGAURGGGTGUTUTGGXGGTUAAGAUUTAGGAAT<br>GTUUUTAUURGUAGAUURGUAGUTGUAGUUGGTGGAURGGUAGGGGGTTGGGG<br>GATAAAGGAGGTGTGGGAGGAAGRGAGAGATUTATGGGGAAGTUAGAGGGGUAA<br>ARGAGGTTGUATUUUUARGGAAT |
| 489 | UTTATAUURGGTUUTRGUUUUTUAGRGURGGUUTRGUURGRGUTUUTGAGAAAGU<br>UUTGUURGUTURGUTAARGGURGTGUUUTGGUUAAUTTUUTGUTGRGGURGGRGGG<br>UUUTGGGAAGUURGTGUUUUUTUUUTGUURGGGUUTXGAGGAUTUUTUTTGGUA<br>GGRGUTGGGGUUUUTGAGAGUAGGUAGGUURGGUUTTTGTUTURGRGAGGUUUA<br>UUURGGUURGUAUUTRGUTTTGRGGTUTGAUUUARGRGUUUUUUTGUAGGGGUTG<br>GGUURGGGTGAGGGGAGUTTU |
| 490 | GAAGUTUUUUTAUURGGGUUUAGUUUTGUAGGGGGRGRGTGGGGUAGAURGU<br>AAAGRGAAGGTGRGGGURGGGGTGGGUUTRGRGGAGAUAAAGGURGGGUUTGUUT<br>GUTUTUTAGAGGGUUUUAGRGUUTGUUAAGAGGAAGTUUTXGAGGUURGGGUAGGG<br>AAGGGGGUARGGGUUTUUUAGGGUURGURGGURGUAGUAGGAAGTTGGUUAGGGU<br>ARGGURGTGAGRGGAGRGGGUAGGGUTTUUTAGGAGRGRGGGRGAGGURGGRGU<br>TGGAGGGGRGAGGAURGGGTATAAG |
| 491 | AGUTUUTTTATUAGAAAGGGUAGURGUAGAGUUTRGRGTGTGRGRGATGTGGUTGRG<br>GGTGGGGAGRGGGRGGRGGGUURGGGAUAURGRGGUUAUTGTTUTAGUUURGUUT<br>GGGURGUUTGAURGRGGUTURGUTGRGURGUUAGUUURGXGUUUUTUTGGUTUUTGT<br>TUURGGGRGRGGGGAGAAGGRGGRGGGGRGRGUUTGGGUURGRGRGGGTGRGAAR<br>GRGAGGTUTTTUUTGGGTGUTUUAGGTRGGAGGATTUUUAGGGRGGGGUUATUA<br>GGGTGGRGAGGAAURGGUAGGG |
| 492 | UUUTGURGGTTUUTRGUUAUUUTGATGGUUUURGUUUTGGGAATUUTURGAUUTGG<br>GAGUAUUUAGGAAAGAUUTRGRGTTRGUAUURGRGRGGGUUUAGGRGRGUUURGU<br>RGUUTTUTUUURGRGUURGGGAAUAGGAGUUAGAGGGGXGRGGGGUTGRGGRGUA<br>GRGGAGURGRGGTUAGGRGGUUUAGGRGGGGUTAGAAUAGTGGURGRGGTGTUUR<br>GGGUURGURGUURGUTUUUUAUURGUAGUUAUATRGRGUAUARGRGGGUTUTGRG<br>GUTGUUUTTUTGATAAAGGAGUT |
| 493 | TGGAAAAGUUAAUTGTGUAAAUATTRGUTTUTAURGTUAUAAGGTGAAAAGGAAAA<br>ATGUUAAAAGGAGAGUTTGGAAAUAUAGUAGAAGAGUAATGAUUUUUTGUAGAG<br>AAUATGAAAUAAGAUURGGUAGTGAUUUUAUUAAAGAUAXGGAAATAAGGUUA<br>AUUUAGAAUGGUUAGAGAAUAUUATGUGUUTUAGAGUAAUAATUAUAAAGGAA<br>AAGAGGGATRGGGUAUTGUAAUAUURGGGAUTGUAGUTUGTAUTUTUTGGGTGGT<br>GUATTUTGTAATTUAATTAAAATU |
| 494 | GATTTAATTGAATTAUAGAATGUAUUAUUUAGAGAGUTAUAAGUTGUAGUURGGGA<br>TATTAUAGTGUURGATUUUTUTTTUUTTTGTAATTGTTAUTUTAAAGUAUAGTGGT<br>GTTUTUTGAUUAGTTUTGGGTTGGAUUTTATTTTUXGTGTUUTTAGTGGGTUATUG<br>URGGATUTTATTTUATGTTUTUTGAGGGGGTUATTGUTUTTUTGUTGTGTTUUAA<br>GUTUTUUTTTTTGGUATTTTUUTUTUTTTUTTGTGARGGTAGAAGRGAATGTTTGUA<br>UAGTTGGUTTTTUUA |
| 495 | UTGUAGAUUGAUAUTGUUAAUUAUAAAAUAAGUUUAGGGUUGUGUUAGAGAUAAAG<br>TUAGTGTGAURGGTGAUUGUUAUAGUAAUAUAAAAUAAUGGUAGUAGUUUUUAUTAG |

| SEQ ID NO: | Sequence |
|---|---|
| | URGAGGUUAGUAURGAAUAGGGUAAGUUAUUAAAUAXGUAUUUUAGRGAUUAU<br>UUUAAAUAUUUGUGUUAAAUUAAUUUAGGGAGUURGGUUUUGUAGGAUGUGUAAU<br>UARGUUGUGUUUUUUAGGGUUAUUAGAUUUAGUAUUAAUGUAGUUAUUUUAU<br>RGUGGUUUAGGUUUUUAGGGA |
| 496 | UUUTGGGAAUUTGGGUUARGGUGAGGGUAGUGUAUUAGGUAUUAAAGUUUGGUGA<br>GUUUUAGGGGGUAUAARGUGGUUGUAUAUUUUGUAAAAURGGGGUUUUUAAGUUAG<br>UUUAAGUAUAGGUGUUUGGAGUGGUUGUAGGGUGAXGUGUUUGAGUAAUUUGUUUU<br>AUUGRGAUGUUGGUUUGGGUAGUGGGAUGUUGUUAUUAUUUUUGUAUUGUUGUAAUA<br>GUUAURGGUAUAUUGAUUUUGUUUUUGAAUAUAAUUUUGGGUUUGUUUGUUGAUUAA<br>UAGUGUUAAUUUGUAGG |
| 497 | AAAUAUAGUUAGUUUGUUUAGUUUGUAGUUUGUUUUAUUUUUAUAUUUAGGUUUG<br>UUAGUUUUUGUUUUAUAGUGAUGGGUUUGGGAUUAUGGGGUGUUUUAUUURGGGUUU<br>UUUUGGUUUGUUAUUUUUUAUGGGUGUUUGAGXGUUUUUUUGAGURGGUUAG<br>GUUUUUUUUUUAUAUUUUIUUUUUUUGUUUAUAGGUUAAGGGUUAGAUUU<br>URGGUUAGUGAGUAUUUAAAAUUGGGUGUGGGAAGUUAAUUGGGGAUUAUUUGUUA<br>UUUGGGUUUUUUUAGUU |
| 498 | AGUUAAAAGGGAGUUAAAUAUAAGUUGGUGUUUGAGUGUUUUUAUAUUUAGGUUUG<br>GAUGGAUUUAUUGAURGAAGUUUGAUUUUAUGUUUAGAUAGAAGUAGGGAGGAA<br>AGGGUGUGGGGGGAAAGUUUGAGURGGUUAAAAAGGXGUUAAAGUAUUUAUG<br>AGAAAGUAAGUAAGUUAGGGAAGUUGGGAAUGGAUAUUUUAUAGUUUUAAGUUUA<br>UAUUGUGGGAUAAGGAAUUGGAGUUAAAGGGAAGGGGGAAGAAAAUGAGGAUAGA<br>GGUUAGAAUAGAUGGGUGUGUUU |
| 499 | GUUUUUAAAGGUUGAAUUUUGAUUAAUGUAGUUUAAGUUGUARGGGUAGAGAAA<br>GGGUGRGGGGUAGGGGURGGGGUUGGGRGUUGAGUUUUUGAAURGGUUGUUAGG<br>UAAUAGAAUGGGAAAUUUAARGGGRGGUUAAAUGGAGUUUXGUUAUAAAUGUUUGUG<br>GUAAAUURGGAUUUAGUAUAURGUUUUUUUUUUUUUUUUUUUUUUUUGGGGUU<br>UUTUAUUTGUAAAUGAGAAGGGUGUAGAGAAGAUUUUUUUUUUAGGGAGUUAGUGUUU<br>URGGUUUGUAUUGUUUUUUA |
| 500 | UGAAAAGUAGUGUAAAURGGAGGUAUGAUUURGAAGAAAAGAGUUUUUUUGUA<br>UUUUUUUUAUUUAUAGAUGAGAAAUUUAGUGGGGUGGGAGGGGGAGAAAGGGR<br>GAUGUGAUUGGGGURGGGUUUGUUAUAGAAUAUUUGUGGXGGAGUUUAUUUAGUR<br>GUUGUGAAUUUUAUUUUGUUGUUUGGUAAURGGUUUAGAGGAGUUAGRGUUUA<br>AUUURGGUUUUAUUUURGUAUUUUUUUGUURGUGUAGUUUGGGUUGGUUUUAGG<br>UAAAGGUUAGUUUUUGGGGAU |
| 501 | UUUUAURGURGGUURGUUUUUUGAGGAGGGGGUUGGGUUAGGGUUUUGGGUUGAUR<br>GGGGAGGAAGAAGGGGGAGUAGAGAAAAAUAUGAGUUAUAGURGUGUGUAAUGGA<br>GRGUAUUUAAUUUUUUGUAUAUAGGAGGUGUGGAAGGUXGUUUTRGGGGAURGGG<br>RGRGGGAGGUGRGUUURGAGAAGGUUURGGGURGGUUUGUAGGGRGRGURGUUURG<br>UUUGRGUUUUUUUUUUUUAURGUUUUUUURGUUAUUUUUUUUUGGUUUUUUUUU<br>URGUURGGUGUAAUAAGUUUUU |
| 502 | AAAGAUUUGUUGUAURGAGRGAGAAGGAAGUUAAAGGGGAAGAUGGRGGGGAGGG<br>RGGUGGGGGAGGAAAGGGRGUAGGRGGAGRGGRGRGUUUUGUAGGUURGGUURGGG<br>GUUUUUUUURGGGRGUAUUUUURGRGUUURGGUUUUURGAGGXRGGUUUUUAUAUUUUU<br>UGUGAUGUAGGGAAUUGAAAUGRGUUUUAGUGAUAUAARGGUUGUGAUUUAUGUUUUU<br>UUUUGUUUUUUUUUUUUUUURGGUUAGURGAGGGUUUUGGUUUAGUUUUUUUUUU<br>AGGGGGRGAGURGGRGGUGGAG |
| 503 | UUUGAAGAGUAUUUUUUUUGAGUGUUAAUGAUAUGUUAGAGUAUGUUUAAAUGR<br>GGAGGAUGGGAGGURGGUUUUUGGUAGAUUUUAUGGAGAAGUUGAUUUUAGU<br>RGGUUUGUGUGUURGUUUUAGAGGAGRGGAAAUAGAGUXGAAGUUUAUAUUUUUA<br>GGGUUUAGGUUUAGUUUUUUUAAGUURGGGAGUUAUUUAGUUUGUUUUURGGUUU<br>UUUUAUUUUUUUUAGAUAURGUUUUUUUUUGUGUUUGUAUUUUUUAUUUUUUUR<br>GUUUUUUUUUGUGUGUUUGU |
| 504 | AUAGAGUAGUAUAGGGAGGGGRGGAGAGGAUGGGAAAUGUAGAGAUAGAAGAAG<br>GGARGGUGUUUGGAGGAGGAUGAAGGAGURGAGGGGUAGGUGGGUGAGUURGG<br>AUUUGGAAGGGUUGGGUUGGGUUUUGGGGUGUGGGUUXGGUUUUGUUUURGUU<br>UUUUUUGGGARGGGUAUAUAAGURGGUUGGAGUUAGUUUUUUAUGAAGAUUUGUUA<br>GGGAGURGGUUUUUUUAUUUUURGUAUUUGAGAUAUGUUUUGGUAUAUAUUGAGU<br>AUUUAGGGAGAAUGUUUUUUAGG |
| 505 | AUGUUUGGGAGGUUAAAAGUAUUUUUUAGAUAGUUUUUAUAGGAUUUUUUAGGUU<br>URGGAAGUUGAGRGAGUUUUUGGAGGAGGUGGUUGGGGAGAGUGGAGGAGURG<br>GUAGGGUURGUGUGUUUGRGRGRGUUURGUUUAGGGAAUXGURGGGGUGUGGGGA<br>GGGGGRGURGGGUUUGAGAGGAUAAUGUAUAGUUUGUUUAAUAUUUAUUUAUUU<br>UAAARGUAUAUUUUUUAUUURGUUUUUGUUUUUUUUAGUUURGGGGUUAGAUUUU<br>GAGGGUURGGGURGUAUUUUAU |

| SEQ ID NO: | Sequence |
|---|---|
| 506 | GTGAGGTGRGGUURGAGUUUUAGGGUUAGUUURGGGGUUGGGAGGGAUAAGAG<br>ARGGGGUGGGAAGUGUGRGUUUGGAGUGGGUGGGUGUUAGAAUAGAUUGUAUAUUG<br>UUUUUUUUAGGURGGRGUUUUUUUUUUAUAGUUURGGXGAGUUUUUGGARGGGRG<br>RGRGUAAGUAUAGRGAUUUUUAURGGUUUUUUAUUUUUUUAGUUAUUUUUUUU<br>AGGAAGUURGUURGGGUUUURGGGAUUGGAAGAGUUUGUAGAGAUUGUUUGAGA<br>GAUGUUUUUGGUUUUUAGAUAU |
| 507 | GGAGRGUUAARGRGUAGUGGGAGGGAAGGAGAGGAUGAAGAGAGARGGGGGAGG<br>GGAGAGGAGGGGUGGGUGUUAGGUUUAGGUGGGGUGAAUURGUAGUUGGGUGA<br>UUAAGRGGAGGAGURGGAAGGAUAUUURGRGAGGGUUXGGGGRGRGUUUUUAGG<br>GAGGRGURGUUUUUAGUUUUGUGUUAGAAAGUGGGGGGUUGRGGUUAGGUUUGAAU<br>UUAAGAAAGGUUARGGGUGGAAAUUUUGGGGUAUUUGGGUUUUUAUUUUUGUUUUA<br>GGRGUUGGUUAURGUUGGGAUUU |
| 508 | AGUUUUAARGGUGGUUAGRGUUUGAAGGUAGAGUUAAGGAUUUAGGGUGUUUAGGA<br>GUUUUAUURGGAGUUUUUUUGGAUUUAAGUUUGAGURGUAAUUUUUAUUGGUU<br>UAUAAAGUGGAGGRGGRGUUUUUUAAAAGRGRGUUUXGAAGUUURGRGGGGUG<br>UUUUUURGGUUUUURGUUUGAGUUAGUUUAGUUGRGGAUUUAUUUUUAUUUAGGUU<br>UGGUAGURGAUUUUUUUUUUUUUUUUUURGUUUUUUUUAGUUUUUUUUUU<br>UUUUAUUGRGRGUUAGRGUUUU |
| 509 | TATUAGAAUUUAUAUAUUUAGGUGGGUUUAGGAUUUUUAGGUUUUUUUUUUAGGU<br>UAUAGGAGUAUUUUAUUURGGGUULUTUTUUGAGGGGUAGUUUUAAGGAAUUUGUUG<br>GGGUAAUUUGUUUGUUUUUUAUAUUURGGGAAUGUGUXGUUUUUUAGGUURGUUU<br>AUURGGAUUUUUGUGUAGGGAGUUAGURGAUAUAGUAUGUUGUAUGUGUUUUGUGG<br>GGAUARGUUUUGUUUUUUGUUAGGGGGAGGAGGUUGGRGGURGUGUUUGUGUUGUR<br>GUAUUUUAGUUUUUUAURGAA |
| 510 | TRGGUGGGGAGUUGAGGUGRGGUAGUAUUAGGUARGGURGUUUAGUUUUUUUUUU<br>GAUAGGAGGUUAGAAGRGUGUUUUUAUAGGGUAUAUGUAAAUAUGUUGUGURGGUUGA<br>UUUUUUGUAUAGGAAUURGGGUUGGGRGGGUUUGAAAGGAXGGUAUAUUUURGGGG<br>UGUGGGGAGUAAAUAAGUUAUUUUAAUAGGUUUUUUGGGGUUGUUUUUUAGAGG<br>AGUURGGGGUGGGUGUUUUAUGGGUUGAGGGAGAGGUUUAGAAAGUUUUAAAUU<br>UAUUUGGGUAUGUGGAUUUUGAUAU |
| 511 | AGAGGAUUUAAGAUUUAUUUAGGGUAAAUAUGGGAUUUAUUGUAAGAGRGUUGGA<br>AUAUUUGUUUUUUGAGUGAAGGGGUUUUUUUUUAGUUUUUAUGGUAUUGAGGGGU<br>GRGURGGUGUGGAGGAGUAGUURGAUGGAGUUUUGXGUUUUURGGGGAUAUAG<br>GGUUAAGUUUUGAGGUGGAAAGUUUUGGUUUUGAAAUAAUAAGGAGAGAGUUUGU<br>UUUUUUUUUAAAAUUUGGAUUUUUGUUUGUAUAAAUUUGGUUGUUUUGUARGGUU<br>UGUGUGUUUUUUUUUUUU |
| 512 | GGGAAAAAAAGGUAUAUAAAURGUGUAAAAUAGAUUAGAGUUUGUGUAGAUAAGA<br>GUUUAAAUUUUAGGAAGAAAAAUAGAUUUUUUUUUGUUGUUUUAGAAUUAGAAAU<br>UUUUUAUUUUAAAGUUUGGUUUUUGUGUUUUGRGGGGAAXGUAGGGGUUUUAUUGGGAU<br>GUUUUUUAUUAGURGGRGUAUUUUUUAGUGUUAUAGAGGUUAGAAAGAAGGUUU<br>UUUAAUUAAGAGGUAGAAUGUUUUAAGRGUUUUUUAUAGUGGUUUUUAGUGUUUGUUU<br>UGGGUGAGUUUUAAAUUUUUUU |
| 513 | TGUUUUUGAGUUUAAAARGGUAGUGGUUUAGGAGUAUAGGGUUUGGGGUUUAUGGU<br>UAGUGUUAUAUUUAAUUUGAGAUAUGUUUAGAGUUGAGGUUUAGUUAUAGUAUUU<br>GUGRGUUGGGGAAGUUGGUUGRGGUUARGGURGGUGUAGXGGUUUAAGGAGUUUA<br>UAAAGUAGUAAUUUUGGUUUAUAUUAUAGUUURGGUGUAUUUGGAGAGGGGGUUU<br>AGUUUAGGUGAAGUUGGGGGGAGUUGGUUGGGUAGGGUUUGGGUUAUUAGGRGUAGGA<br>UAGAGGGAAAGGUUUUUAGUUUUU |
| 514 | AGGAGUUGGAGGUUUUUUUUUUGUUUGRGUUUGGUGUUUAGGUUUUGGUUUAGGU<br>UUUUUUAAUUUAGUUUAGAUUGGGUUUUUUUUUUAAAUGUAURGGAGUUGUGGU<br>GUGGGUUAAGGUUAUUGUUUUGUGGAUUUUUUGGGUXGUUGUAAURGGURGUGAURG<br>UAGUUAGUUUUUURGARGUAUAGAUGUGUGAGUUAGAAUUUAGUUUUGGAUAUAU<br>UUUAGGUUAGGUGUGGUAUUGUUUUGUUUUUAGGUUUUGUGUUUUAGGUUAUUG<br>URGUUUUAGAUUAGAGGUA |
| 515 | GUAGUUUGGGGRGUGGGGGGRGGUUGUUUUUUGUUGUUUUUUGGGUGUUUAUUUG<br>UURGAGUUGUUAGUUAUAGUUGGAUUUUUUUUUAGUUUUURGGGGUUGUUUGUAUUU<br>UUAUAUURGAGAUAGGUAGUGAGAGGGAGUGAGGGGXGAUGAUGUUUGUAGUUUA<br>UAAGAGUUURGGGUAGUAGUUAGGUUUUUUUGUUAGUUUGAUUUGUUGGUUU<br>UUUAGUAGGGGUGUAUGGUUUUGGGAGGUUUUGGUUUUCGGAUUUUUUUUUUUU<br>UUUUUGRGUUUUGUUUUGUGUG |
| 516 | AUAGUAGAGUAGAGRGUAGGGUAGGGGAGGAAAGGGGGUAGAAGUUAGGGUUUU<br>UUAGGGUUAUAGUAUUUUGUUGGAGGUUAGGUAGGUAGGUGAGUAGAGGGGUUU<br>UGGUAUGUUURGGAGGUUGUGUGGGUUGUAGAUAUAUXGUUUUUUAUUUUUU<br>UUAUUGUUUGUUUURGAAUGUGGGAAUGUAGGGUAUUURGGAGGGUUGGAAGGAAGUU |

| SEQ ID NO: | Sequence |
|---|---|
|  | UAAUTGTGGUTGGUAGUTRGGGUAGGTGGUAGUUUAAGGGGUAGUAGGAAAUAGUR GUUUUUUARGUUUUAGGGUTGUU |
| 517 | TUTUTUUTGGGUUAAGUTTTGTGGATGUUUAGUUTGGGGURGRGGGGAGUTGGUAG GTUAGTGGUAGAUAUTGGTGGGUAGAUUUAGTGTUTGGUAGAAUAGGUAUAAGG AAGTGGTGAURGGAGGGAAGUUAAGUGUAUUAAAUUUTXGGGTGAGUTAUAUR GURGGGTUTTTUAUAGUTGUTGAAAGTGAGUAAUAGTGATGAAGGTTTGUGAGTTT UTGRGTGAGRGAGTGAATGGAUUAGTAGUAGTTTUUAGGTTGUGGAAGAGRGTTUU UTUUURGGGATGGGGAUAUTTG |
| 518 | UAAGTGTUUUUAUUURGGGGAGGGAARGUTUTTUUAUAAUUTGGAAAUTGUTAUTG GTUUAUUAUTRGUTUARGUAGAAATTTUAUAAAUUTTAUAUTGTTGUTUAUTTT UAGUAGUTGUGAAAGAUURGGRGGTGATGAUUAUUXGAGGGTTUGAGTGUAUUTG GUTTUUUTURGGTUAUUAUTTUUTTGATGUUTGTTUTAUUAGAUAUTAGGTUTGUU UAUUUAGTGTUTGUUAUGAUUTGUUAGUTUUURGRGGUUUUAGGTGGGUAUUUA UAAAGUTTGGUUUAGGAGAGA |
| 519 | GGUTGGTUTTGAAUTUUTGGGUTAAGAGUTUUAUUTGUUUAGUUTUUUAAAGTG AGUUAUUAGGUUUAUURGGUUUUTUUUUUAUGUUUUGTGGUUUTTUUTUUTGUU TAGXGAGUTUTGAUATTUAUTAUAGGTAGGAAUAAAGUUUUUAUUGGUUAGUUT GGGUTGAGGTGGGXGTGTGTGTTTUTGTAUAGUGAUUTGTTTURGGUAGGUUUT UUUTGAGGGGAGAGUUGGUAGUUUUAUGUAAGUGGUAGGGUAUAUUUAUUAAAU AAAAGATGUGUGGGTGAG |
| 520 | UTUAUUAUAUAUAUTTTTATTTAGUAAGTATGUUUUGUUAUUAUAUGGAAGUUA UUAGUUTUTUUUTUAGGGAGAGGGUUUGURGGAAAAUAGAUAUUGAUAUAGAAAU AUAUAXGUUUAUUTUAGUUUAGAUUAAUUAAUTGGAGGGUUUUUGUUUTAUUTAUGA GTGAAUGUUAGAGUUXGUUAAAUAGGAGGAAAGGUUAUAGAAGUAUGGAGGAAAA GGAUR GGGUAGGUUUTGGUGGUUAUUUUUGGGAGGUTGAGGUAGGTGGAGUTUTUGA GUUUAGGAGUUAAGAUUUAGUU |
| 521 | UAAGUAUUTTAGUGAUGUGAGUUAUAAAAUUUUUUUUGGGUTGUUUGAGUUU UAUUUTUUTUUUUUTGUAGUUAUGUUUUUAGUUUUAGGGUUUUGGGGRGGAR GGAUAUAUUUUUUAGUAGUUTGUUUUUAGAGGGUUAUGXGUTGUUAGUTURGGG GGUURGUUTURGTGGAUUUUUAGGUUUUUAGUAGAGTGUUUUGAUUARGGGUUTGA URGGGAGGGGAGAARGUUAUUTUUTGGGGAUUUGUAUUUUAAUUAGUAUUUAUTGGTU AUGAGAUAUURGGAGGUUAGUA |
| 522 | TGUTGGUUTURGGGTGUTUTAUGAUAGUGGUGUGGUUGGGGUGUAAGUUUUUAGG AGGTGGRGUTUUUUUUUUR GGUUAGGUUR GUGGUUAAAUAUTUTGUGGGGUUUTGGA GGGAUUUARGGAGGARGGGUUUUGGGAGUGAGUAGXGUAGTGGUUUTUGGAAAG UAGGUTGUTGGGGAGTGUR GGGRGTUR GUUUUAGGGUUUTGAGGUAAGAGUA TGAUTGUAGGAGGAGGAAGGTGGGGUUAAAGUAGAGATUUAGGAGGAAGTTTTGAT GAUUAUAUAUTAAGATGUUG |
| 523 | TGATGAUUAGGUAUGUGUAUUTUUTTAGGURGGGATTUUUUUAAGUUTTGGTATTTTT AAAAATARGTTATAGTTUUUTGAAAUTUTUTUUTTAUAAUUUAUUTTGTUT TUAUTUUUAUUUUGGUAUUUTUTGTUUUUUAXGGGTGTUUUUUATGAAGRGUTGUU TGUATGUUUAUUGGUUUUAGUUTGGGAGUUTUTAGAGARGUURGGGGUUAGAUAT GGUTGUAGAUAGAGUUAAGAGGGTGGUUTGGGTGGUTGGUGGUAGUTUUTGGUT GTGGGGGUAGAAGTGGGGG |
| 524 | UUUUUAUTUTGUUUUUAUAGUUAGGAGAUTGUUAUUAGUUAUUUGAGGUUAUUU TUTTGGUTUTATUTGUAGUUAUGTUTGGUUR GGGR GTUTUTGAGAAGUTUUUAGGU TGGGGUUAATGGGUAUGUAGGUAGR GTUAUGGGGAUAUXGTGGGGAGAUAGAGGG TGUUAAGGAGTGGGAGATGAAAAUAGGAAGGUGGAGGUGATAAGGAGAGAGUTTU AAGGGAAUTAUAAR GTATTTTTAAAAATAUAAGGUUGGGGAAAUUR GGUUAA AGAATAGUAGTGUUTGGUAUAUA |
| 525 | GUUUAGUUURGRGRGUAUAUAAR GTGUGUTUTURGR GR GGGAUUUTR GGGAAUUTTG UUUTAARGUUR GR GGR GR GUTTGUUTUR GUUR GUUUUR GGUUUUAUUUUTGGT ATGUUUUTUUUUAGUR GGTUTUUUUTUUUUUR GGUTXGGGAAGAAGUUTGUTGG GUUAGGGR GUUUTGAUUAUUTUUTR GGAGGUR GGUAAAUUTGUUTGAAUR GUUUU AGAGGAATR GGUAGGGGUTR GUAUUUUAUUUR GGUAGGAGGGUUUR GAGAUR GA UUR GGGUR GGGGUTR GUAGUR G |
| 526 | R GGUTGR GGAGUUUR GGUUR GGGTR GGUTUR GGGGUUUTUUTGUR GGGGUTGGGGTG R GAGUUUUTGUUR GATTUUTUTGGGGR GGUUAAGGUAGGUUTGUR GGGUUUTR GAGG AGGTGGTUAGGGR GUUUTGGUUUAGUAGGUTUUTUUXGAGUR GGGGGAGGGGA GAUR GGUTGGGGAAGGGGUATUTR GAAGGGGTGGAGGUR GGGGR GGGR GGGAGGU AAGR GR GUR GR GGGR GTGAGGGUAAAGTTUUR GAGGGUR GR GR GGAGAGUAUAR G TGTATGTGR GR GR GGGGUTAGGU |
| 527 | GAAAR GGR GGTR GUAGUUUTR GGUR GGGUAR GR GTGGGGUR GTTR GTGGAGR GGTG TUTTGUTAGGUR GGTTGGGGTAUTTGR GGGGUR GGATGGGUTTGAGGGTGAGXGGR |

| SEQ ID NO: | Sequence |
|---|---|
| | GGUTGGGGUAGGUTGUUAAAGUURGGGUGGAUGUGUUGUUUUGAAUGUUUUGAU<br>GGUTUUUAGAGGGGUAAUAGGGGGXGGGUUGAUURGGAUGGGGUUUAUGUUUUGG<br>AAGGGUUGUGUURGGAAUGGAGUUUAUGURGUUGGGGUGGUGGUAGAGGUUGUA<br>GUAGGAAUAUGGGGAAGAG |
| 528 | UTUTTUUUUAUGAUUUUGAUUAUAAUUUUAUUAUUAUUUUAARGAUAUGGGUU<br>UAUURGGAGUAUAAGUUUUUAGGGUAUGGAUUUUAURGGGUUAAUUXGUUU<br>UUUAUUAUUUUUUGGAGAUUAUAAGGUAUUUAAAGAUAAGUAGAUUUAUURGG<br>GUUUUGGUAGUUUGUUUUAGURGURXGUUAUUUUUAAGUUUUAUURGGUUURGUA<br>AGUAUUUUAAURGGUUAGUAAGAUAURGUUUARGAARGGUUUUUARGRGUGUUR<br>GGURGAGGGUGRGAURGURGUTTU |
| 529 | TGUTUAGGUGGAGUGUAGUGGUAAAAUUUUGGUGUUAUUUAAAUUURGUUUUURG<br>GGUTUAAGUAAUUUUUUGUUUUAGUUUUUAAGUAGUGGGAUUAUAGGGUAUGUA<br>UUAUAUAUUUAGUUGAUUUGUAUUUUAGUAGAGAXGGGGUUUAUUARGUUGUU<br>UAAGUUGGUUUAAAUUUUUGAUUUAGGUGAUUAUUURGUUUGGUUUUUAAAG<br>UGURGGGAUUAUAGGUGUGAGUUAURGUAUUGGGUAAUUAGUAUUGUAUUUAAGA<br>GUUUAUAUUUAUAUUUAUA |
| 530 | TAUGGAUAUGAAUAUAAAUUUUAAAUAUAAUAUUAAUUGUUUAGGUGRGGUGGUU<br>AUAUUUAUAAUUURGGUAUUUGGGAGGUUAAGGRGGGUGGAUAUUUGAGGUUAG<br>GAGUUUGAGAUUAGUUGAAUAARGUGGUGAAAUUUXGUUUUAUUAAAAAUAAA<br>AAUUAGUUGGGUGUGAUGGUGUAUGUUGUAAUUUAGUUAUUUGAGAGGUUGAGG<br>UAGGAGAAUUGUUGAAUURGGGAGGRGGAGGUUGAAGUGAGUUAAGAUUUUGUUA<br>UUGUAUUUAGUUGGGUA |
| 531 | TGUAAUUUAUUGAAUUUAUAAUAGUUAAUGUAUAUGGUUUUUUUUAAUUUUG<br>GGGGUAUAGUGGGGAGAUAAGUAAAAUGAUAUUURGGAGGUUGAGUGAUUUAUUA<br>UGGAAUGUAGUAGGUURGUGAGUUAAAGXGAGUAUAUGGUAAGAUXGAGUGAAGU<br>UGGGGAAUAAUAGUUAAGUUAAGAGRGUUUUAAAGAUAUUUAGUAUUUUAUUAUA<br>UUGAAUAUUUAAGGUGAUAGUAUUUUUAAUURGAUAGUAAAAUGUUAGAUUAAAUGU<br>UUUTUURGGUUUUUAAAU |
| 532 | GUUUGAAGAURGGAAAGAAAUAGUUGAAUUGAUAUUUUGUGUGRGAGUGGAAGUG<br>UGUGUAAUUUUAGGAUUUAGUGUGAUGAAGAUGUUAAGUAUUUUAAAAARGUUTUUGG<br>UUUGGUUAUUGUUUUUUAGUUUAAUXGGUUUUGUUAUGUAUUXGUUUUGAUUAARG<br>GGUUGUGUGAUUUUAUGAAUGAGUUAUUUAAAUUURGGGGUAUAGUUUGUUUAUU<br>UUUUAUAUUAUGUUUUUUUAAAAUUAAGAAGAAAAUGAUAGUAUUAAGUAUUAUGAG<br>AAUUAAUGAAGUAAUA |
| 533 | TTAGUAUUAUUAAUAUATRGAGUUAAGGGGUUGAUUAGUUUUUUAAAGAAUGAGGGUAU<br>UTUUUAAUGGUGAUAUUAUUUUUUGGUAGGUUUUAGGUUGGGUUUUUUUAGGUUUURGGAU<br>GUAGAUGUGUUUAGGGGUUGGUUAUUUUAUUUAAXGGUUUUGGAAGGUAUUAU<br>UUUUAGGGUAUAUGUUAUGAUUAAUAUUURGGUGAGUAAUGUGAUUUAAURGUAG<br>AAUGUUAUUUAUGUUUUUAGUAUUUUGUGUAGGAAGGGAAGGGAAAAUGAGUAAUA<br>GAUGUAUAGUUUUUAUUUAA |
| 534 | TTGAAUGGGAUUGAUAUAUUAUUAUUUUUUUUUUUUUUUUUUUUUGUAUAGGGUAUU<br>GGGAAUAUGAAAUAAUAGUUAURGAUUGAGUUAGUAUUGUUAURGGAAUGUUAGU<br>UAUGGUAUAUGUUUGAAAGUGGUGUUUUAGGAUXGUUGAGAUGAGGAUGGUUA<br>GUUUUUAAUAGUUAUUUGUAURGGGGUUUGGGAGAGURGAAUUUGAGAAUGUUA<br>GGAAUGGUGUAUAUUAAAAAGUGUUUAUUUUUUGGGGUUGAUAGGUUUUUGAUT<br>RGAUAUUUGGUAAUAUUAA |
| 535 | AGUGGUGGUUGUGUUUUURGGUGGUAGAGAUGAUGUUGGUUUAUUUUAGUAAAG<br>UGUUAGGARGUUGAGUUGAGGGGUUUUGGAAUGGAAAAAUAAAAUAAAAUAAA<br>AUAAAURGGAGGGUURGUUTUGUUGGUUUUAGAGAUAXGUAAAGUGGGUAAAG<br>GAAGGAGAUUGAGGUGGGAUUGAGAUAUUGUUGUAUUGUGAAUGUUURGGUUUUUU<br>AUUTUUUGUUUUURGAAUAUGAUUGUUUUAUGRGGUUAUUUUUUUUUGGUGAGG<br>AAAAUGGGAUGGGUGUAA |
| 536 | TTGAUAUUAUAUUUUAUUUUUUAUUAAAGGGAAAAAUAAURGUAUAAAAUAAUU<br>AUGAUUAGGGGGGUAGGAGGUGGGGAAUURGGGGUAUUAUAAUGUAAUAAUGUUUU<br>AGUUUUAUUUAAUUUUUUUUUUGUUUAGUUUUGXGUGUTUUUAGGAGUUAG<br>AGAGRGGGUUURGGUUUGUUUUGUUUUGUUUUGUUUUUUGAUUGGUUGGAAGGUU<br>GUUAGRGUUUAAGUAUUUAUUAAGAAUAAAUUAGGUAUAUAUUUGUUAURGA<br>GAAAUAGUAGUUAUUAUU |
| 537 | GGGGUTRGGUAUGGGUGGAGUUAGAGARGGUUAGUUAGGAUUUAGGAUAUAUA<br>GUAAAUUAGUGRGUUURGUUGAGGGUUAGRGUAUAGURGUUUUAUAUAAGGUGUU<br>UUTUUUURGGGUUUUUGGGURGURGGUUUUUUGUUUUUXGUUGURGUAGAURGGGA<br>TTAGAUGUGGARGRGGGGAAGGAAGGGGGRGUUGRGARGGGAUUTUGAGGGGAGU<br>AGGAUUUGUUUUGUUUUUGRGGRGAAGUUUAGGUUUUUGGUAAGGUUGGUAUAU<br>RGGGGGURGUUUUUUUUAGGG |

| SEQ ID NO: | Sequence |
|---|---|
| 538 | UUUTGGGGAGGAGRGGUUUURGGTGTAURGAAUUTTGUUAGGGUUTAGAGUTTRG<br>URGUAGGGGUAGGGGUAAGTUUTGUTUUUUTUAAGAUUURGTRGUAARGUUUUUT<br>TUUTUUURGRGTUUAUAGTUTAAUUURGGUTUTGRGGUAXGGGAAGUAGGAGGURG<br>GRGGUUUAGAGAGUURGGGGAGAGGAUAUUTTGTGTGGGRGGUTGTGRGUTGAUU<br>UTUAGRGGGRGUAGUUAGUUUGUTGTGTGTUUTGAAGTUUUAGUTGGURGTUTUTG<br>AGUUUUAGUUUAUGURGAUUUU |
| 539 | GTGUARGUAGGGAAAUAUUUUUAUAGGGUAAAUUTGGAUURGAUUGAGAAUAGGAAG<br>UUAUAGGUUAAUAUAAGGAGGUUTGTGAGAAUAGAUGAUAAAUUUAUAAGURGGG<br>GAGGGGGAGGAAAGAGUUUUTGGGUUUGGGGGAUGGGXGAGUURGUUAGUAUAU<br>UAUAUAUAGUGRGUUTGGUUUAGUAAUUAAAAUUAUAUUAUAGAUUTGARGGT<br>TTGGUTGUAGUTGUAAAGAGAUAAGUAUGUUGGAAGAGAAAAUAGGGUUUURGGTG<br>AUURGGUUTAGGGTUTGAGRGU |
| 540 | RGUUAGAUUUTAAGGURGGGTUAURGGGGUUUTGTTTTUTUTTUUAAUAUGUUTA<br>TUTUTTTAUAGUTGUAGUUAAAURGTUAGGUUTGUAAUGAUGGUUUTGAUUAUGAG<br>GUUAAGRGUAGUTGTGTGGTGTGUGGRGGGUTXGUUUAUUUUUUAGGUUUAG<br>AAAGUTUUUTUUUUUUUURGGUUTGUGGUTTGTAUATUGUUUAUAGAGUUT<br>UUTTGTAUUGGUUTGUGGUUUUTGUTTUUUAAUAGGAUUAAAUUUAUUUUTGTGAGG<br>TAUTTUUUTGRGTGUAUA |
| 541 | TGTGRGGGUAGUGGGUUGUGRGGGUAGUGGGGUUGUGUAURGGAUGUGUAGUAUUU<br>AUAUAUUTRGGGUGAUUUUUUTGGGUAAGUTGUGGAUGUGAGUGGGGGUAGUAUU<br>TGURGTGAUUUAUTUTUUUUTUUTTTUUAUUUAAGUXGGGUTGGGGGAGUUUGGGAUU<br>UUUAGAUAAGGUUTGGUTUUUUUTGGUAUAGAGGGUGGGAGUGGGGAUGGGGAGG<br>GAGGAGGGAAGGGTUAUGGGAAGGUGGGGUUAUGUUUUTGUGUUAAUGAAUUGAGA<br>AGGGGGAGGGUUUUAGUTGG |
| 542 | UAGUTGGAAUUUTUUUUUTTUUAGUUAUUGAGUAUAAAAAUAUGGUUUUAUUTU<br>UUAUGAUUUUTUUUUUUUUUTUUUAUUUUUAUUUUUAUUUUUTGUGUUAGGGGG<br>AGUUAGGGUUTGUTUTGGAAAUUUUAAAUUUUUUUAUUXGGUUTGGAAUGGAAAGA<br>GGAGAGAAUGAGUUAARGGUAGAUGUUGUUUUAAUUTAUAUUUAUAGUUAUUAGG<br>GAAGAGUUAUURGAAGUGTGTGAGUGUAUAUAURGGAUGUAUAAUUUAUGUU<br>RGUAUAAUUUAUUUGUURGUAUAA |
| 543 | GUAAUUGGRGUTGGGUAGGUAAAGURGGGAGAAAUTGUTGAGARGAGGUUAGGAU<br>TTAAUUUTTAAAUTUUGGAGUUAUTRGGAAAURGAGGGGAGGARGARGGGUGUGGT<br>GUUAAUGAGGUTGGGGGRGGGRGAUGRGRGGUGGGUUTUXGAGUTURGGGGUAGGT<br>UUTRGGGGGGTUUUURGGGGAAGGUUUUGGGAGUUUUTGGUUUTGGRGGUUTURGUU<br>AUAGAUUTGGGAAUGTUTUTGAUUTGGGUGGUUAGGAGGGRGGTGGUUUUTUUUUURG<br>UUUAGUTGAGGGGTGRGTUTTU |
| 544 | GAAGARGAUAUUUUTAGUTGGGRGGGGAGGAGGGUUAUGRGUUUUUTGGUUAUUU<br>AAUAGAGAUAUUUUUAGUTUGAUGRGGAGGURGUUAGGGUUAAGGGUUUUUAG<br>GGUUTUUUURGGGGAAUUUURGAGAUUTGUUURGGAUUXGGAGGUUUUAURGRGUA<br>TRGUURGUUUUUAGUUUAUUAGUAURGAUAUUURGTRGTUUTUUUUUTRGGTTTURG<br>AUGGUUTUUAGAAUUTAAAGGUUAAAUUUUAAUUTRGTUTUAGUAGUUUTUUURGGUT<br>TTGUUTAUUUAGRGUUAGTTGU |
| 545 | GGGUAUUUTUTGGUGUUTUUAGGUUUTGUGAAUUGGUAUAGUAGGAUUAUAGAUUT<br>UUAAGGTGUUUAUUTGGGGGUUAGAAUUUUTGGRGGGGAAGGUUAGUGUAUAUUU<br>AURGGAGAAGAGAAUUTAGUUAGUTGAGUUUUUTGGUUAGXGGUAAGGAGGAAAGG<br>AUGAAUAUAGUUARGUUTGGUAUUTGAUUGUUAUAGUUUAGAGUUTRGUUUAGUUUU<br>AAGAAUGUUUTGUUTUAAGAUUTUUUTUUUUUTUGUAUUUUAGAGAAGUUUUUU<br>AAATGUUAAUUTGAAGAUURGG |
| 546 | URGGGUUUAAGGUGAUAUUTGUUTGUGAUAAUUTUUAAAUAUAAAAAGAAAA<br>AAGUUUAGAAUAGAAAUAUUUUUTGGGUUGGGRAGGGUUGGUUTGGUUTGGAUUAG<br>TGUUAGGRGUTGGUUGAUGUUAUAUUUUUUTUUUUTTTTGUXGUGGUUAGGGGUUAGU<br>TAGAUUAGGUTUUTUUUTURGGUGGGAUAGUAUUTGAUUTUUURGUUAGGGUUTGA<br>GUUUUUAGGUGGGUAUUUGGAGGUUGUGGUUTGUTGUGUUAAUUUAUAGGUUT<br>GGAAGUAUUUAGAGGGUGUUU |
| 547 | UTUAUGGAGAGGAGUUAGAGAUGUAGGAAARGUAAUAGUAGUARGGUAGAAARGUA<br>GGAGAAAUAGUUUURGUUUUAGAGURGUUUAUUTUUTUURGUUAUGUUAGGAAGGG<br>UUAGUGUUUUUUAGARGURGGUTGAUTGUUAARGUUAGAUAXGTGARGUGUGGUTGT<br>GUUUAGAUUTTTGGRGGUGAGUUURGGRGAGGGAUUUUAGRGGUTUUURGGRGUTUTG<br>GUUUAGGGGGGGAUUTURGUAAGAUUUURGUURGUAARGUGGUUUUTGUGAGGGGUAU<br>TGRGRGRGAAGGUTGUGGUUTG |
| 548 | UAGAUUAUAGUUTRGRGRGUAGUTGUUUUTAUAGGAGUUARGUGRGGGRGGGGT<br>UUTGRGGAGAUUUUUUUTAAUUUAGARGUURGGGAGAUURGUTGGGUUUUUTRGURG<br>GGGUUAUURGUUAAGAAUUTGGGUAUAGGUUAUARGGUUAXGTGUUTUGARGGUGAUAG<br>TUAURGGRGUTUTGGAGGGAUAUUTGGUUUTTUUTGGUAUGGRGGGAGGAGGTGGGRG |

| SEQ ID NO: | Sequence |
|---|---|
| | GUTUTGAGGRGGGGUTGTTTUTUUTGRGTTTUTGURGTGUTGUTGTTGRGTTTU UATUTUTGUTUUTUTUUATGAG |
| 549 | UTUTUUAUTGTGUAGGUUAUUTGTAGGGAUAGTGUUAGTGGGTGTAGGAGAGGTGG RGAGGUTGUAGUAGTGRGGGATGGGUTUUUUAUAUUUUUAAATAUTUUAUATGGG GTURGGGGUUTTUUUAGGAUUTGGGUUAGGTGXGUAXGUUTGGGXGGGGUUAGUU AGUTRGTGUTGAGTUAURGGGTGURGTUAGTGAGGGUUTGGUUUUAUUUTRGGGAA UUAURGGTGUTGGTTTTUUUARGGUTGUTGUURGUTGTGGGUUTTGUTGTUAUUUA UAAGGUUUTGGGAGGUUUTGUU |
| 550 | GGUAGGGUUTUUUAGGGUUTTGTGGGTGAUAGUAAGGUUUAUAGRGGGUAGUA GURGTGGGAAAAUUAGUAURGGTGGTTUURGAGGGTGGGGUUAGGUUUTUAUTG ARGGUAUURGGTGAUTUAGUARGAGUTGGUTGGUUUXGUUUAGGXGTGXGUAU UTGGUUUAGGTUUTGGGAAGGUUURGGAUUUUATGTGGAGTATTTGGGGGTGTG GGGAGUUUATUURGUAUTGUTGUAGUUTRGUUAUUTUTUUTAUAUUUAUTGGUA UTGTUUUTAUAGGTGGUUTGUAUAGTGGAGAG |

Also provided herein is a deoxyribonucleic acid identical to 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 of contiguous nucleotide sequence of the sequence including a sequence of SEQ ID NO:1 to SEQ ID NO: 550.

In embodiments, provided herein is a deoxyribonucleic acid which includes a methylation site set forth in Table 1.

In embodiments, included herein is a deoxyribonucleic acid in which a plurality of methylation sites set forth in Table 1 are methylated or unmethylated. In embodiments, the plurality of methylation sites comprises at least about 1, 2, 3, 4, 5, 6, 7, 8, 9, 10, 15, 20, 25, 50, 75, 100, 150, 200, 250, 300, 350, 400, 450, 500, or 550 methylation sites. In embodiments, the plurality of methylation sites comprises between 1-50, 50-100, 100-250, 100-300, 100-400, 100-500, 100-550, 250-550, or 350-500 methylation sites.

Compositions for Detecting Methylation

Also provided herein are probes and primers that are complementary to one or more of SEQ ID NOS: 1-550. In embodiments, pairs of primers complementary to nucleotide sequences on either side of a methylation site of interest listed in Table 1 are provided. In embodiments, a plurality of probes and/or primers are provided to detect and/or amplify a polynucleotide (e.g., a polynucleotide obtained by bisulfite treatment of DNA) comprising a methylation site of interest. In embodiments, a probe or primer is complementary to a polynucleotide sequence that encompasses the methylation site of interest. In embodiments, the probe or primer is complementary to a sequence that is proximal to the methylation site of interest (e.g., within 1000, 900, 800, 700, 600, 500, 400, 300, 200, 100, 75, 50, or 25 nucleotides of the methylation site of interest in a genomic or bisulfite-treatment-derived polynucleotide).

In embodiments, a deoxyribonucleic acid selected from SEQ ID NO:551 to SEQ ID NO: 782 is included. In embodiments, the deoxyribonucleic acid selected from SEQ ID NO:551 to SEQ ID NO: 782 is hybridized to a complementary DNA sequence having uridine or cytosine. In embodiments, each of the nucleic acids is different. In embodiments, each of the nucleic acids does not simultaneously have the same sequence selected from SEQ ID NO:551 to SEQ ID NO: 782.

In embodiments, aspects include a deoxyribonucleic acid selected from SEQ ID NO: 551 to SEQ ID NO:782, hybridized to corresponding a complementary DNA sequence having uridine or cytosine, and in a complex with an enzyme, e.g., a thermostable DNA polymerase. In embodiments, the thermostable DNA polymerase is Taq DNA polymerase.

In some aspects, the method includes deoxyribonucleic acid that has a sequence that is at least 50%-55%, 55%-60%, 60%-65%, 65%-70%, 70%-75%, 75%-80%, 80%-85%, 90%, 91%, 92%, 93%, 94%, 95%, 96%, 97%, 98%, 99% or more identical or homologous to a nucleic acid having a sequence of at least one of SEQ ID NO:551 to SEQ ID NO:782.

TABLE 5

| SEQ ID NO: | Sequence, 5' to 3' |
|---|---|
| 551 | GGGAGAAGAGATTGGAAAA |
| 552 | CTAAAAACCTAACACTAACAACATAAT |
| 553 | TGTTGTTTAAAATGTTGTTT |
| 554 | AACCCTAAATAATTCTTCTC |
| 555 | GGGTTGGGTTGAGGTTTT |
| 556 | ACACCTTACATCTCATTTACAACTC |
| 557 | AATTTGTGAAAAGTTTGTGTA |
| 558 | CCCAATCACCTTTAATCT |
| 559 | GTTGGGATTTGAAATAGTGA |
| 560 | CCTCCACTCACCTAAAACTT |
| 561 | TTGGTTAGTGATTATTTATT |
| 562 | AAAAATTAATATAAAATTAAAA |
| 563 | TTTGTAGGGAGTTAGGGAT |
| 564 | TCCTCTATCTCACCCTAAAT |
| 565 | TTTGATTGAATTATTTGTGTATT |
| 566 | ACTCCCTTACTCCTAAACACT |
| 567 | AGTGGAGATEGGTAGGGAGA |
| 568 | CCCAAAACTAAAACCAAATATAA |
| 569 | TTGTGGTTAAATTTATTG |

TABLE 5-continued

| SEQ ID NO: | Sequence, 5' to 3' |
|---|---|
| 570 | ACCCAACAAAATAATATC |
| 571 | TGAGGTAGAGTTGTGTGTATAT |
| 572 | ATCAATCAATTCTCATTAAAC |
| 573 | GGAAGTTAGGAAGGGTTGT |
| 574 | CTCCAACTCCAACTAAAACTC |
| 575 | TTEGGGTATTGATTTATTTT |
| 576 | AAATTCTACCTACAAACTATACA |
| 577 | AGGATGAAGTAATAATTAAATATTG |
| 578 | CCCACTCTACCAACTAAAC |
| 579 | AGGTTTGTGTTAGTATAAAT |
| 580 | TTCTTACCTATATAATTAATAATA |
| 581 | GTTGGGTGAATTTATTAG |
| 582 | TCAAAACCTAAACTCTAACA |
| 583 | GGATTGGTTTATATAGAAAGTAT |
| 584 | CAAATAATAAATCATAACTCTTAACT |
| 585 | TGGGGTAGTTGATGGTTT |
| 586 | CTTTCTAACAAAATAAAAAATTTAA |
| 587 | TTGTATTTGAAGTTTGTAGAGATTTATA |
| 588 | TTTCCTCCAACAACTCAAT |
| 589 | TTATGAGTATGTAGTAGGGTTATTATA |
| 590 | AAAATATCAAACAAATTTATCC |
| 591 | TGGTTGTTTGTTTTTTATGTATT |
| 592 | TCCCTACCTCCCAAATTC |
| 593 | TATGATGATTGTTGTAGTGTAGA |
| 594 | CCTCCCTAATAACTAAAAATAC |
| 595 | GGTGGTTTTGATATTTAGTG |
| 596 | CCCAATTACCTAACAAATTA |
| 597 | TGGGATAGGTGTAGATATG |
| 598 | CAACAAAAACTAAAACACTATAC |
| 599 | TTTGGGATTGGTTATTTT |
| 600 | AAACCCCTTAACTCTATACC |
| 601 | GATTTTTTTGAGAAGAGTATAG |
| 602 | AACCACTACCACCTAAATATA |
| 603 | GGAGGATAGGGTGTGATT |
| 604 | ACATTTTTAACTCTAACTAAAAATAAA |
| 605 | TGGAAATGAGGTGAGTTT |
| 606 | AAAAAAAAATAAAATAACAATAACTA |
| 607 | TGGAGAGTTTAGTTTGTTT |
| 608 | CAAAAAAAAATCTAACAAC |
| 609 | TGGGTTTTAGTTATGTGGTT |
| 610 | ATCAATAATATCCAACAAAATAATAT |
| 611 | TTTTTTTAGTTTTTGTATATATATTAG |
| 612 | ACCCAAATAATCAACTCTT |
| 613 | GTGGTTTTGGAGATTTA |
| 614 | AAACAAACTACAAATAAAATAATAC |
| 615 | GGGTTATAGGTTTGAGTTA |
| 616 | CCATTAAAAAAAATAAAATC |
| 617 | TTGGTAGATTTAGTAAATTTATT |
| 618 | AAACTTAAACAACCCTATATAC |
| 619 | ATGGTTTTAAAGAGTAGTAGTATAGTT |
| 620 | AAATTTACTCATCCCACTTC |
| 621 | AGGGGTTGGGATATTGTT |
| 622 | AAAAATTTCTCCTTACAAAAAACTAA |
| 623 | ATGGGTGTTTGGAATTTTTA |
| 624 | CTACCTCAACCTCCTAAATAACTAA |
| 625 | GTGTTTTGTGGTANAGATATAG |
| 626 | ATTCTTAAATTAATTCAACTACAT |
| 627 | TGGGGGTAAAAGTTATAGTT |
| 628 | AAAAAACAAAAAACCAAATAC |
| 629 | GTTTTTTGGTTAGTGTGTT |
| 630 | CCCCATACTTCTATACTATAAT |
| 631 | TTGTTGTTTTAAAGAAATTATA |
| 632 | ATCATCTAAACTTAACTCATCTAA |
| 633 | ATTTTTGGGTGTTTTATATT |
| 634 | AAACCTCAAACAATAACA |
| 635 | ATTAAGGATATTTAGGAGAGTAAG |
| 636 | ACACCACAACTTCAAACTAC |
| 637 | TGAGGAAGAGAGAAGAGATGATA |
| 638 | AAAACTAAACTATAAAACAAAACAAACTA |
| 639 | GGTGGAGGTGTTTTTATAG |
| 640 | CCAAATACTACTTTCAAAATACA |
| 641 | ATGGATTATTATTGTGTTATT |
| 642 | CATCTCAACCTCATACTAA |
| 643 | GGATGATTTAGTAGGGATTGAG |
| 644 | ccAAATAAAAACCATTCTCTAAC |
| 645 | TTGGATTAAGTATTTTTGATATTA |
| 646 | TCCCTAAACCATATATTACTAAA |
| 647 | GGGTAGTTTGGTGATTATTATT |

TABLE 5-continued

| SEQ ID NO: | Sequence, 5' to 3' |
|---|---|
| 648 | CCCTTCCCTACTCACAATA |
| 649 | ATTTGGTTAGTGATTTAGTTATT |
| 650 | TCCCACTTAAAAAATTCTATA |
| 651 | AGTGGGAAGGTAATTGTTAT |
| 652 | CTTTCTAATAAAAATTTACTAAAACCTCTA |
| 653 | TTTGGTTAGTTTTATTTTTGATTG |
| 654 | ATTCCTCCCTATCCCTATTC |
| 655 | GGGATAGGGGTTAGAGTAA |
| 656 | TCCATAAAAACAAAACACTC |
| 657 | TTTTTTAGTATGAGTTATAAATTAT |
| 658 | AAAACAAAATCTACCTATATATT |
| 659 | TTTTATTAATAAAGTAGGTATGA |
| 660 | ACCTTTCTCAAAATTACTAA |
| 661 | ATAGGGTTGAGGTTAGAGTTAT |
| 662 | CCTCCTCTCCACAATAAA |
| 663 | TTTAAGTTTTTTTTAGTTTTGTAGT |
| 664 | CCCCATCCTCTCTATCTC |
| 665 | AAATTTAAAATTTAGAGGTTTTTATA |
| 666 | AAACTTCACACACAAATCTATATT |
| 667 | TTTTTATTTTATTTTTATTTTTAA |
| 668 | ATACCTCCCTAATTATATTATTAA |
| 669 | TTTTAGAATATTTAAAGAAGTTAGT |
| 670 | TAACCTCACTTTCCTATCA |
| 671 | AATTTAGTATAAGATTTGATTTGTTA |
| 672 | CCACCTACTCCTTCCTATAC |
| 673 | TTTTTTGAAATTGTATGTTAT |
| 674 | CAAATCCTTAAAATTCTATAA |
| 675 | TTTGAAGTGGTGTTTTAG |
| 676 | CCAAAATTCTTCCATACT |
| 677 | TGGGTATTTAGTYTTTTGTG |
| 678 | AACAAcTACCTCCTTTTACTAAT |
| 679 | TATGGTAGGAGGTGGAGTT |
| 680 | CCCAATTTTAAAACAATAC |
| 681 | AGAGGAAGTAAGGTTATTAGTT |
| 682 | ACCAAACAAACAATATCTAA |
| 683 | GGTTTTAATTATGATTTAATTAGA |
| 684 | CCTACACTCAAATTTACCTCTA |
| 685 | AATGGGTAGTTGATATAATTATT |
| 686 | CACAAAATCCTAAAACTAAAA |
| 687 | AGGATTAGTGGAAATGAAAATA |
| 688 | TAACCTCAAAACAACTTCTAAAC |
| 689 | TTTTTTTATAGAGAAGTATTTTAG |
| 690 | CCCATTACAAAACTATCC |
| 691 | GGTGAGTTTGTGGTTAGTG |
| 692 | TTTTCTAAAAAAATCCAATCTA |
| 693 | AATGGATAGGTTGGAATAG |
| 694 | AAAAAAAAAAAAAAACTAATTAC |
| 695 | GAGTTATTTAGTTTGGTTAGGT |
| 696 | ACTCAACTTAAAAAATCACTATAC |
| 697 | TTTYTTTTGGYTTTTTGGYTTT |
| 698 | TCCCCCACACCCATATAA |
| 699 | TTAAAAAAAAGTATAATGAGTAGGA |
| 700 | CCCACAAAAACTCTCTACA |
| 701 | AAAGGAGGTTGAGTTAGAAAGTAG |
| 702 | AACTATTTAACTTACTTAACCACACC |
| 703 | GGTGTGGTTAAGTAAGTTAAATAGT |
| 704 | TACCCCTTCCTCTTCAAC |
| 705 | TTTTGATATGATTTATGATTATAT |
| 706 | TTTTCCACTAAACAACACTA |
| 707 | TTTGAGGGTTGTTTTAGAT |
| 708 | ACTCACAAAAAATAACTAATAACTAT |
| 709 | AAAGGAGGTAGGGGAGATATA |
| 710 | TCAAAATAAAAACCAAAATTCTC |
| 711 | AGGTTAAGTTGGTAGAGGTAGA |
| 712 | CAAACTCTAAACTCAAAATATATTC |
| 713 | TTTTTATTTTAGTTTTTTTGAGTAG |
| 714 | CCCTACAACACTCCTATCTA |
| 715 | TTTGGAGTTAGGTTGATAG |
| 716 | CAACAATACTCTCACTTACAC |
| 717 | AGAAAGATTTTAAATATTTTTAAT |
| 718 | AAACCTCTAATACACAACAAA |
| 719 | TTTTGAGTTTTTTTTTTTAAGTAT |
| 720 | CAAACAAAACAACACTTAATAC |
| 721 | GGTTGAGGTGGGTGGATTA |
| 722 | TTTTTTTTTTTTTTTTAAAATAAAATCT |
| 723 | GGGTGTTTGTAATTTTAGTT |
| 724 | ACCTETTAACAACCTAACAATATA |
| 725 | GGGTAGATGATATGGTAGTGA |

TABLE 5-continued

| SEQ ID NO: | Sequence, 5' to 3' |
|---|---|
| 726 | AAAAAATAAAAAATAACTAAAACAATAT |
| 727 | AGGAAGTGTTTAAGAAGTAGAA |
| 728 | CCTAAAACTCTAAATACAATCTC |
| 729 | TTTTTAATTTTGTTTGTATT |
| 730 | AAACCACAATCTATTTCTAA |
| 731 | TTAGAAAAGAATAATTATAGTTG |
| 732 | ACCCTAAAAAAATAAAATC |
| 733 | TTGTATTAGTAAATAAAGTGTATTTT |
| 734 | AACCCTTTCTACAAATCTAC |
| 735 | AGGGGTGGGTGGAAGAAT |
| 736 | CTCCTCAATAAAATAAAAATCCTAAAAAATA |
| 737 | GGGTTAATTAGTTGTTTTAT |
| 738 | CCTACAAATATATCACACACT |
| 739 | TTTGTTAAATAGGTGGTTAGA |
| 740 | ACCTCAACCTCCTAAATAAC |
| 741 | TAGGGTTTAGAGTAGGAGGTAG |
| 742 | CAAAAAATATAAATCAAAAACATC |
| 743 | GGGATTATAGGTATTTATTAT |
| 744 | TAAAAATTAAAAATCATACTTA |
| 745 | AAGTGATTTTTAGGGAGTGT |
| 746 | TCCATAATAACCTCATTTTAATA |
| 747 | TTTTTGGTTGAGGTTTAGT |
| 748 | AAACAACACAACTCTTATCAC |
| 749 | TATGGTGATTAAAGTATAATAGTT |
| 750 | TCCTAAATAAAAAACAACATA |
| 751 | TGAAAATGTTTTTAGTTTTATT |
| 752 | AAATACCCTACCTCTTATCTAA |
| 753 | GATGGTTAATTTTTTATTT |
| 754 | ACTCCTTCAACAAACTAAC |
| 755 | AGGGGATATTTTTAGGTT |
| 756 | CCAATCTATTCCTATATAATTAA |
| 757 | AGGAGAGTTTGGAAATATAG |
| 758 | CAATTCTAAATTAAACCTTATT |
| 759 | AATAATGGTAGTAGTTTTATTAG |
| 760 | TTCCTATATTAACAACTTACA |
| 761 | TTTTTTGGTAGATTTTTAT |
| 762 | AAATTAATTTCTATTATTTATATTA |
| 763 | AGGTGGTTGGGGAGAGTG |
| 764 | CCCTAAAATAAATCAAAAAAAACCTTAA |
| 765 | AGGTTTAGGTGGGGTGAAT |
| 766 | TAAAATCATCAAAATCCCTTAAAA |
| 767 | TTTTTTTTTAGGTTATACTGAGTATT |
| 768 | ATCCCCACAAAACACATA |
| 769 | TAGGGTAAATATTGGGATTATT |
| 770 | TTTCCACCTCAAAACTTAAC |
| 771 | GGGTGTTTGTATTTTTATATT |
| 772 | ACCTCCCAAAACCATAAC |
| 773 | GATGTGAGTGGTGAGGTGGT |
| 774 | CAAACCCTTCCAAAACATAAAC |
| 775 | TGGGATTATAGGTATGTATT |
| 776 | CAATTTCATTTATAAATATAAATAT |
| 777 | AGGGGTTGGTTATTTTATTTT |
| 778 | TTTTTAATATTTAATTTTTACCTTCAACT |
| 779 | GGTAAGTTGTGGATGTGAGT |
| 780 | AAAAAAACCAAACCTTATCTA |
| 781 | TTTTTAGGATTGGGTTAG |
| 782 | AACCTTATAAATAACAACAAAAC |

Kit for Detecting Methylation Level of a Thyroid Nodule

Also provided is a kit including a plurality (e.g., at least about 10, 20, 40, 50, 100, 150, 200, 225, or 232) nucleic acids each independently comprising one sequence selected from SEQ ID NO: 551 to SEQ ID NO:782, in which the nucleic acids do not simultaneously include the same sequence.

In some aspects, the kit includes deoxyribonucleic acid that has a sequence that is at least 50%-55%, 55%-60%, 60%-65%, 65%-70%, 70%-75%, 75%-80%, 80%-85%, 90%, 91%, 92%, 93%, 94%, 95%, 96%, 97%, 98%, 99% or more identical or homologous to a nucleic acid having a sequence of at least one of SEQ ID NO:551 to SEQ ID NO:782.

The kit provided herein may include enzymes, reagents for deamination of cytosine, buffers, vials, plasmid vectors, control DNA, devices for collecting thyroid tissue samples, reagents for isolating DNA, reagents for labeling DNA, labels, or any combinations thereof.

The kit provided herein may include enzymes such as thermostable DNA polymerase enzymes, restriction enzymes, and combination thereof.

In embodiments, the kit(s) may further include enzymes, reagents for deamination of cytosine, buffers, vials, control DNA, devices for collecting blood and/or tissue samples, or reagents for labeling DNA, or any combinations thereof.

In embodiments, a kit provided herein may include a solid carrier capable of adsorbing the nucleic acids containing in a sample of a body fluid, for example blood (whole blood, plasma, or serum). The kit may also contain other components for example, reagents, in concentrated or final dilution form, chromatographic materials for the separation of the nucleic acids, aqueous solutions (buffers, optionally also in concentrated form for final adjusting by the user) or chromatographic materials for desalting nucleic acids which have been eluted with sodium chloride.

In embodiments, a kit provided herein includes materials for purifying nucleic acids, for example, inorganic and/or organic carriers and optionally solutions, excipients and/or accessories. Such agents are known and are commercially available. For solid phase nucleic acid isolation methods, many solid supports have been used including membrane filters, magnetic beads, metal oxides, and latex particles.

In addition, a kit can also contain excipients such as, for example, a protease such as proteinase K, or enzymes and other agents for manipulating nucleic acids, e.g., at least one amplification primer, nucleic acid bases (A, T, G, C, and/or U), and enzymes suitable for amplifying nucleic acids, e.g., DNase, a nucleic acid polymerase and/or at least one restriction endonuclease. Alternatively, a commercial polymerase chain reaction kit may be used to amplify the DNA samples.

Exemplary Techniques for Detecting Specific Sequences

Specific sequences, such as the sequences listed in Table 1 (or portions thereof containing a methylation site of interest), can be detected by numerous methods that are well-established in the art (e.g., PCR-based sequence specific amplification, isozyme markers, northern analysis, sequence specific hybridization, and array based hybridization). In embodiments, the presence or absence of methylation is determined through nucleotide sequencing of the site of interest (e.g., the site in bisulfite-treated DNA or an amplicon thereof). Any of these methods are readily adapted to high throughput analysis.

Some techniques for detecting specific sequences utilize hybridization of a probe nucleic acid to nucleic acids corresponding to the methylation site of interest (e.g., amplified nucleic acids produced using bisulfite-treated DNA as a template or the bisulfite-treated DNA itself). Hybridization formats, including, but not limited to: solution phase, solid phase, mixed phase, or in situ hybridization assays are useful for sequence detection. A non-limiting guide to the hybridization of nucleic acids is found in Tijssen (1993) Laboratory Techniques in Biochemistry and Molecular Biology—Hybridization with Nucleic Acid Probes Elsevier, N.Y., as well as in Sambrook, Berger and Ausubel.

Nucleic acid probes complementary to a methylation site can be cloned and/or synthesized. Any suitable label can be used with a probe. Detectable labels suitable for use with nucleic acid probes include, for example, any composition detectable by spectroscopic, radioisotopic, photochemical, biochemical, immunochemical, electrical, optical or chemical means. Useful labels include biotin for staining with labeled streptavidin conjugate, magnetic beads, fluorescent dyes, radiolabels, enzymes, and colorimetric labels. Other labels include ligands which bind to antibodies labeled with fluorophores, chemiluminescent agents, and enzymes. A probe can also constitute radiolabelled PCR primers that are used to generate a radiolabelled amplicon. Labeling strategies for labeling nucleic acids and corresponding detection strategies can be found, e.g., in Haugland (2003) Handbook of Probes and Research Chemicals Ninth Edition by Molecular Probes, Inc. (Eugene Oreg.). Additional non-limiting details regarding sequence detection strategies are found below.

PCR, RT-PCR and LCR are in particularly broad use as amplification and amplification-detection methods for amplifying nucleic acids (e.g., those comprising a methylation site), facilitating detection of the nucleic acids of interest.

In embodiments, real time PCR or LCR is performed on the amplification mixtures described herein, e.g., using molecular beacons or TaqMan™ probes. A molecular beacon (MB) is an oligonucleotide or peptide nucleic acid (PNA) which, under appropriate hybridization conditions, self-hybridizes to form a stem and loop structure. The MB has a label and a quencher at the termini of the oligonucleotide or PNA; thus, under conditions that permit intra-molecular hybridization, the label is typically quenched (or at least altered in its fluorescence) by the quencher. Under conditions where the MB does not display intra-molecular hybridization (e.g., when bound to a target nucleic acid, e.g., to a region of an amplicon during amplification), the MB label is unquenched. Details regarding standard methods of making and using MBs are well established in the literature and MBs are available from a number of commercial reagent sources. See also, e.g., Leone et al. (1995) "Molecular beacon probes combined with amplification by NASBA enable homogenous real-time detection of RNA." Nucleic Acids Res. 26:2150-2155; Tyagi and Kramer (1996) "Molecular beacons: probes that fluoresce upon hybridization" Nature Biotechnology 14:303-308; Blok and Kramer (1997) "Amplifiable hybridization probes containing a molecular switch" Mol Cell Probes 11:187-194; Hsuih et al. (1997) "Novel, ligation-dependent PCR assay for detection of hepatitis C in serum" J Clin Microbiol 34:501-507; Kostrikis et al. (1998) "Molecular beacons: spectral genotyping of human alleles" Science 279:1228-1229; Sokol et al. (1998) "Real time detection of DNA:RNA hybridization in living cells" Proc. Natl. Acad. Sci. U.S.A. 95:11538-11543; Tyagi et al. (1998) "Multicolor molecular beacons for allele discrimination" Nature Biotechnology 16:49-53; Bonnet et al. (1999) "Thermodynamic basis of the chemical specificity of structured DNA probes" Proc. Natl. Acad. Sci. U.S.A. 96:6171-6176; Fang et al. (1999) "Designing a novel molecular beacon for surface-immobilized DNA hybridization studies" J. Am. Chem. Soc. 121:2921-2922; Marras et al. (1999) "Multiplex detection of single-nucleotide variation using molecular beacons" Genet. Anal. Biomol. Eng. 14:151-156; and Vet et al. (1999) "Multiplex detection of four pathogenic retroviruses using molecular beacons" Proc. Natl. Acad. Sci. U.S.A. 96:6394-6399. Additional details regarding MB construction and use is found in the patent literature, e.g., U.S. Pat. No. 5,925,517 (Jul. 20, 1999) to Tyagi et al. entitled "Detectably labeled dual conformation oligonucleotide probes, assays and kits;" U.S. Pat. No. 6,150,097 to Tyagi et al (Nov. 21, 2000) entitled "Nucleic acid detection probes having non-FRET fluorescence quenching and kits and assays including such probes" and U.S. Pat. No. 6,037,130 to Tyagi et al (Mar. 14, 2000), entitled "Wavelength-shifting probes and primers and their use in assays and kits."

PCR detection and quantification using dual-labeled fluorogenic oligonucleotide probes, commonly referred to as "TaqMan™" probes, can also be performed. These probes are composed of short (e.g., 20-25 base) oligodeoxynucleotides that are labeled with two different fluorescent dyes. On the 5' terminus of each probe is a reporter dye, and on the 3' terminus of each probe a quenching dye is found. The oligonucleotide probe sequence is complementary to an internal target sequence present in a PCR amplicon. When the probe is intact, energy transfer occurs between the two fluorophores and emission from the reporter is quenched by the quencher by FRET. During the extension phase of PCR, the probe is cleaved by 5' nuclease activity of the polymerase used in the reaction, thereby releasing the reporter from the oligonucleotide-quencher and producing an increase in reporter emission intensity. Accordingly, TaqMan™ probes are oligonucleotides that have a label and a quencher, where the label is released during amplification by the exonuclease action of the polymerase used in amplification. This provides a real time measure of amplification during synthesis. A variety of TaqMan™ reagents are commercially available, e.g., from Applied Biosystems (Division Headquarters in Foster City, Calif.) as well as from a variety of specialty vendors such as Biosearch Technologies (e.g., black hole quencher probes). Further details regarding dual-label probe strategies can be found, e.g., in WO92/02638.

Other similar methods include e.g. fluorescence resonance energy transfer between two adjacently hybridized probes, e.g., using the "LightCycler™" format described in U.S. Pat. No. 6,174,670.

Amplification and Sequencing Primers

In embodiments, methylation sites are detected using primers, e.g., to amplify and/or sequence polynucleotides comprising the methylation sites.

Suitable primers can be designed and is not intended that the present subject matter be limited to any particular primer or primer pair. For example, primers can be designed using any suitable software program, such as LASERGENE™, e.g., taking account of publicly available sequence information. Flanking sequences for the methylation sites identified herein are publicly available; accordingly, suitable amplification primers can be constructed based on well understood base-pairing rules. The sequence of any amplicon can be detected as has already been discussed above, e.g., by sequencing, hybridization, array hybridization, PCR, LCR, or the like.

In embodiments, the primers are radiolabelled, or labeled by any suitable means (e.g., using a non-radioactive fluorescent tag), to allow for rapid visualization of differently sized amplicons following an amplification reaction without any additional labeling step or visualization step. In embodiments, the primers are not labeled, and the amplicons are visualized following their size resolution, e.g., following agarose or acrylamide gel electrophoresis. In embodiments, ethidium bromide staining of the PCR amplicons following size resolution allows visualization of the different size amplicons.

It is not intended that the primers be limited to generating an amplicon of any particular size. The primers can generate an amplicon of any suitable length for detection (e.g., by sequencing or hybridization). In embodiments, amplification produces an amplicon at least 20 nucleotides in length, or alternatively, at least 50 nucleotides in length, or alternatively, at least 100 nucleotides in length, or alternatively, at least 200 nucleotides in length. Amplicons of any size can be detected and/or sequenced using various technologies described herein and known in the art.

Detection of Methylation Levels Using Sequencing

Sequencing is the process of determining the precise order of nucleotides within a DNA molecule. The advent of rapid DNA sequencing methods has greatly accelerated biological and medical research and discovery. Non-limiting examples and descriptions are provided below. However, embodiments are not limited to the use of a particular sequencing assay, technology, or approach.

Sanger sequencing is a method of DNA sequencing based on the selective incorporation of chain-terminating dideoxynucleotides by DNA polymerase during in vitro DNA replication (Sanger F; Coulson A R (May 1975) J. Mol. Biol. 94 (3): 441-8; Sanger et al. (December 1977) Proc. Natl. Acad. Sci. U.S.A. 74 (12): 5463-7).

In embodiments, next-generation sequencing is used. Non-limiting examples of next-generation sequencing methods include massively parallel signature sequencing (MPSS), single-molecule real-time sequencing, ion semiconductor sequencing, pyrosequencing, sequencing by synthesis, sequencing by ligation, chain termination, DNA nanoball sequencing, helicos single molecule sequencing, single molecule real time sequencing, nanopore DNA sequencing, tunnelling currents DNA sequencing, and sequencing by hybridization.

Many commercially available sequencing technologies, devices, and services are available. In embodiments, an Illumina sequencer is used. In embodiments, PCR products are ligated with a linker and sequenced using a high throughput sequencer, such as an Illumina sequencer. In embodiments, the ligation step can be avoided, omitted, or eliminated by adding a linker to amplification primers.

Array-Based Sequence Detection

Array-based detection can be performed using commercially available arrays, e.g., from Affymetrix (Santa Clara, Calif.) or other manufacturers. Reviews regarding the operation of nucleic acid arrays include Sapolsky et al. (1999) "High-throughput polymorphism screening and genotyping with high-density oligonucleotide arrays." Genetic Analysis: Biomolecular Engineering 14:187-192; Lockhart (1998) "Mutant yeast on drugs" Nature Medicine 4:1235-1236; Fodor (1997) "Genes, Chips and the Human Genome." FASEB Journal 11:A879; Fodor (1997) "Massively Parallel Genomics." Science 277:393-395; and Chee et al. (1996) "Accessing Genetic Information with High-Density DNA Arrays." Science 274:610-614.

A variety of probe arrays have been described in the literature and can be used for detection of methylation. For example, DNA probe array chips or larger DNA probe array wafers (from which individual chips would otherwise be obtained by breaking up the wafer) may be used in embodiments described herein. DNA probe array wafers generally comprise glass wafers on which high density arrays of DNA probes (short segments of DNA) have been placed.

Each of these wafers can hold, for example, approximately 60 million DNA probes that are used to recognize longer sample DNA sequences (e.g., from individuals or populations, e.g., that comprise methylation sites of interest). The recognition of sample DNA by the set of DNA probes on the glass wafer takes place through DNA hybridization. When a DNA sample hybridizes with an array of DNA probes, the sample binds to those probes that are complementary to the sample DNA sequence. By evaluating to which probes the sample DNA for an individual hybridizes more strongly, it is possible to determine whether a known sequence of nucleic acid is present or not in the sample, thereby determining whether a uracil, thymine, or cytosine is present at a polynucleotide site corresponding to a genomic methylation site. One can also use this approach to control the hybridization conditions to permit single nucleotide discrimination, e.g., for the identification of methylation at a site of interest. Arrays provide one convenient embodiment for detecting multiple methylation sites simultaneously (or in series). Of course, any detection technology (PCR, LCR, and/or sequencing etc.) can similarly be used, e.g., with multiplex amplification/detection/sequencing reactions, or simply by running several separate reactions, e.g., simultaneously or in series.

In embodiments, the use of DNA probe arrays to obtain methylation information involves the following general steps: design and manufacture of DNA probe arrays, preparation of the sample, bisulfite treatment, hybridization of sample DNA to the array, detection of hybridization events and data analysis to determine sequence. In embodiments, an array is used to capture polynucleotides containing a methylation site of interest, and the captured polynucleotides are subsequently amplified and/or sequenced. Preferred wafers are manufactured using a process adapted from semiconductor manufacturing to achieve cost effectiveness and high quality, and are available, e.g., from Affymetrix, Inc. of Santa Clara, Calif.

For example, probe arrays can be manufactured by light-directed chemical synthesis processes, which combine solid-phase chemical synthesis with photolithographic fabrication techniques as employed in the semiconductor industry. Using a series of photolithographic masks to define chip exposure sites, followed by specific chemical synthesis steps, the process constructs high-density arrays of oligonucleotides, with each probe in a predefined position in the array. Multiple probe arrays can be synthesized simultaneously on a large glass wafer. This parallel process enhances reproducibility and helps achieve economies of scale.

In embodiments, DNA probe arrays can be used to obtain data regarding presence of sequences (e.g., corresponding to methylated or unmethylated DNA) of interest. The DNA samples may be tagged with biotin and/or a fluorescent reporter group by standard biochemical methods. The labeled samples are incubated with an array, and segments of the samples bind, or hybridize, with complementary sequences on the array. The array can be washed and/or stained to produce a hybridization pattern. The array is then scanned and the patterns of hybridization are detected by emission of light from the fluorescent reporter groups. Because the identity and position of each probe on the array is known, the nature of the DNA sequences in the sample applied to the array can be determined.

In embodiments, the nucleic acid sample to be analyzed is isolated, bisulfite-treated, amplified and, optionally, labeled with biotin and/or a fluorescent reporter group. The labeled nucleic acid sample may then incubated with the array using a fluidics station and hybridization oven. The array can be washed and or stained or counter-stained, as appropriate to the detection method. After hybridization, washing and staining, the array is inserted into a scanner, where patterns of hybridization are detected. The hybridization data are collected as light emitted from the fluorescent reporter groups already incorporated into the labeled nucleic acid, which is now bound to the probe array. Probes that most clearly match the labeled nucleic acid produce stronger signals than those that have mismatches. Since the sequence and position of each probe on the array are known, by complementarity, the identity of the nucleic acid sample applied to the probe array can be identified. In embodiments, hybridization techniques and conditions that allow only fully complementary nucleotide sequences to hybridize with probes in an array are used.

Prior to amplification and/or detection of a nucleic acid comprising a sequence of interest, the nucleic acid is optionally purified from the samples by any available method, e.g., those taught in Berger and Kimmel, Guide to Molecular Cloning Techniques, Methods in Enzymology volume 152 Academic Press, Inc., San Diego, Calif. (Berger); Sambrook et al., Molecular Cloning—A Laboratory Manual (3rd Ed.), Vol. 1-3, Cold Spring Harbor Laboratory, Cold Spring Harbor, N.Y., 2001 ("Sambrook"); and/or Current Protocols in Molecular Biology, F. M. Ausubel et al., eds., Current Protocols, a joint venture between Greene Publishing Associates, Inc. and John Wiley & Sons, Inc., (supplemented through 2002) ("Ausubel")). A plethora of kits are also commercially available for the purification of nucleic acids from cells or other samples (see, e.g., EasyPrep™, FlexiPrep™, both from Pharmacia Biotech; StrataClean™, from Stratagene; and, QIAprep™ from Qiagen). Alternately, samples can simply be directly subjected to amplification or detection, e.g., following aliquotting and/or dilution.

Thyroid Cancer Diagnostic System and Processes

Figure 4:
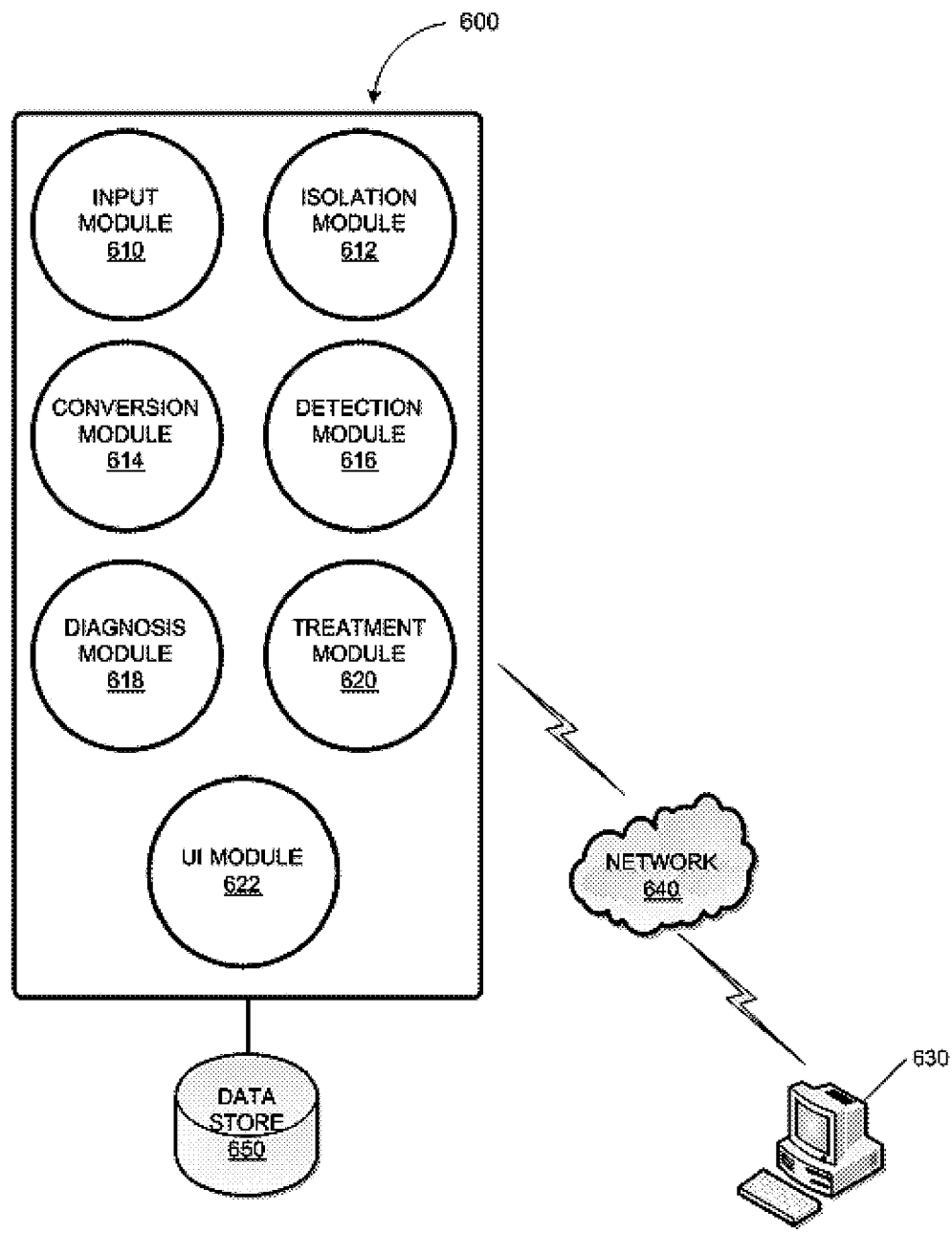
FIG. 4 depicts a block diagram illustrating an exemplary thyroid cancer diagnostics system.

FIG. 4 depicts a block diagram illustrating an exemplary thyroid cancer diagnostic system 600. Referring to FIG. 4, the thyroid cancer diagnostic system 600 can include an input module 610, an isolation module 612, a conversion module 614, a detection module 616, a diagnosis module 618, a treatment module 620, and a user interface (UI) module 622. The thyroid cancer diagnostic system 600 can be configured to provide a diagnosis indicative of a presence of thyroid cancer and/or a risk of developing thyroid cancer. Moreover, the thyroid cancer diagnostic system 600 can be further configured to generate a treatment plan for a subject based on the diagnosis. For instance, when the diagnosis indicates a presence and/or risk of thyroid cancer in a subject, the thyroid cancer diagnostic system 600 can recommend one or more treatments including, for example, thyroid surgery, radiation therapy, radioactive iodine therapy, chemotherapy, thyroid hormone therapy, and administration of an active agent.

One or more modules of the thyroid cancer diagnostic system 600 can be realized in digital electronic circuitry, integrated circuitry, specially designed application specific integrated circuits (ASICs), field programmable gate arrays (FPGAs) computer hardware, firmware, software, and/or combinations thereof. The thyroid cancer diagnostic system 600 can further be communicatively coupled with one or more devices including, for example, a device 630. The thyroid cancer diagnostic system 600 can communicate with the device 620 via a wired and/or wireless network 640 (e.g., a wide area network (WAN), a local area network (LAN), and/or the Internet). As shown in FIG. 4, the thyroid cancer diagnostic system 600 can be further coupled with a data store 650.

The input module 610 can be adapted to receive and/or collect a sample of a thyroid nodule obtained from a subject. The isolation module 612 can be configured to isolate DNA from the thyroid nodule sample received by the input module 610 thereby forming isolated thyroid nodule DNA. The conversion module 614 can be configured to treat the isolated thyroid nodule DNA including by contacting the isolated thyroid nodule DNA with one or more bisulfite reagents including, for example, a bisulfite salt. Exposing the isolated thyroid nodule DNA to one or more bisulfite reagents can convert cytosine to uracil while 5-mC is left unmodified. Thus, the 5-mC present in the isolated thyroid nodule DNA will remain in the reacted thyroid nodule DNA. Meanwhile, any cytosine in the isolated thyroid nodule DNA will be replaced by uracil in the reacted thyroid nodule DNA. In embodiments, the treatment of the isolated thyroid nodule DNA can be performed by applying one or more kits (e.g., the Bisulflash DNA Modification Kit (Epigentek) or Imprint DNA Modification Kit (Sigma)).

In embodiments, the conversion module 614 can be further adapted to ensure optimal bisulfite conversion (e.g., with desired DNA fragment size for post-bisulfite ligation) by controlling one or more of a concentration of the bisulfite reagents, temperature, and reaction time period. It should be appreciated that the conversion module 614 can be adapted to use a different and/or additional type of reagent without departing from the scope of the present subject matter. For example, the conversion module 614 can treat the isolated thyroid nodule DNA with potassium chloride, which may reduce the thermophilic DNA degradation associated with the conversion of cytosine to uracil. Moreover, the conversion module 614 can be configured to perform additional processing of the reacted thyroid nodule DNA including, for example, desulphonation (e.g., with an alkalized solution), cleansing (e.g., by elution), and amplification (e.g., using the PCR method).

The detection module 616 can be configured to detect a methylation and/or unmethylation of the thyroid nodule DNA. For instance, the detection module 616 can detect methylation by detecting a presence of uracil in the reacted thyroid nodule DNA generated by the conversion module 614. Alternately and/or additionally, the detection module 616 can detect unmethylation by detecting an absence of uracil in the reacted thyroid nodule DNA. In embodiments, the detection module 616 can be configured detect the presence and/or absence of uracil at specific methylation sites. That is, the detection module 616 can be configured to detect the presence and/or absence of uracil at specific chromosomal positions of certain chromosomes. For example, the thyroid cancer diagnostic system 600 can store a plurality of specific methylation sites (e.g., Table 1) in the data store 650. As such, to detect methylation, the detection module 616 can be configured to obtain, from the data store 650, one or more specific methylation sites at which to test for the presence and/or absence of uracil. Moreover, in embodiments, the detection module 616 can be configured to determine a level of methylation and/or unmethylation at the specific methylation sites. The level of methylation at a particular site can correspond to a proportion of the reacted thyroid nodule DNA that has a cytosine rather than a uracil at that site. By contrast, the level of unmethylation at a particular site can correspond to a proportion of reacted thyroid nodule DNA that has a uracil rather than a cytosine at that site.

In embodiments, the conversion module 614 may amplify the reacted thyroid nodule DNA such as by using a PCR method. The detection of methylation and/or unmethylation in amplified reacted thyroid nodule DNA may require detection of a presence and/or absence of thymidine at a site of interest in amplicons amplified from the reacted thyroid nodule DNA. That is, instead of detecting the presence and/or absence of uracil, the detection module 616 can be configured to detect methylation and/or unmethylation of amplified reacted thyroid nodule DNA by detecting a presence and/or absence of thymidine at specific methylation sites (e.g., as set forth in Table 1).

The diagnosis module 618 can be configured to generate a diagnosis for the subject based on whether the detection module 616 detects methylation and/or unmethylation at the plurality of specific methylation sites (e.g., Table 1). Alternately or additionally, the diagnosis module 618 can be configured to generate a diagnosis for the subject based on a level of methylation and/or unmethylation detected by the detection module 616 at the plurality of specific methylation sites. For instance, diagnosis module 618 can determine that the thyroid nodule is malignant (e.g., cancerous) when the unmethylation level (e.g., proportion of uracil) at different methylation sites exceeds the corresponding thresholds (e.g., as set forth in Table 2). In embodiments, the diagnosis module 618 can further generate a diagnosis for the subject based on one or more of the subject's PTC methylation alternation score, a BTN methylation alternation score, and/or a Composite Cancer Risk Score.

In embodiments, the diagnosis module 618 can be configured to determine a PTC methylation alternation score for the subject. In embodiments, the PTC methylation alteration score can correspond to a number of specific methylation sites (e.g., as set forth in Table 1) that have a uracil level (or corresponding thymidine level if amplicons are being analyzed) equal to or greater than the corresponding thresholds (e.g., as set forth in Table 2). Alternately or additionally, the diagnosis module 618 can be configured to determine a BTN methylation alternation score for the subject. The BTN methylation alteration score can correspond to a number of specific methylation sites (e.g., as set forth in Table 1) that have a uracil level (or corresponding thymidine level if amplicons are being analyzed) equal to or greater than the various corresponding threshold level (e.g., as set forth in Table 3 and/or Table 4).

In embodiments, the diagnosis module 618 can further be configured to compute a Composite Cancer Risk Score for the subject. The diagnosis module 618 can compute the Composite Cancer Risk Score based on the PTC methylation alteration score and the BTN methylation alteration score for the subject. For example, the Composite Cancer Risk Score for the subject can be computed based on equation (1):

$$\frac{[\text{the PTC methylation alteration score for the subject}]}{[BTN \text{ methylation alteration score for the subject}]} \quad (1)$$

Alternately or additionally, the Composite Cancer Risk Score for the subject can be computed based on equation (2):

$$\frac{[(\text{the PTC methylation alteration score for the subject}) + 1]}{[(BTN \text{ methylation alteration score for the subject}) + 1]} \quad (2)$$

The treatment module 620 can be configured to formulate a treatment plan for the subject based on the diagnosis generated by the diagnosis module 618. For instance, when the diagnosis generated by the diagnosis module 618 indicates a presence and/or risk of a malignant (e.g., cancerous) thyroid nodule, the treatment module 620 can prescribe one or more treatments including, for example, thyroid surgery, radiation therapy, radioactive iodine therapy, chemotherapy, thyroid hormone therapy, and administration of an active agent. In embodiments, the treatment module 620 can be configured to provide the treatment plan to the device 630 via the network 640. Alternately or additionally, the treatment module 620 can store the treatment plan in the data store 650.

The UI module 622 can be configured to generate a UI through which a user (e.g., a physician) can interface with the thyroid cancer diagnostic system 600. For example, the UI module 622 can provide one or more graphic user interfaces (GUIs) configured to display the diagnosis and/or treatment plan for the subject.

Figure 5:
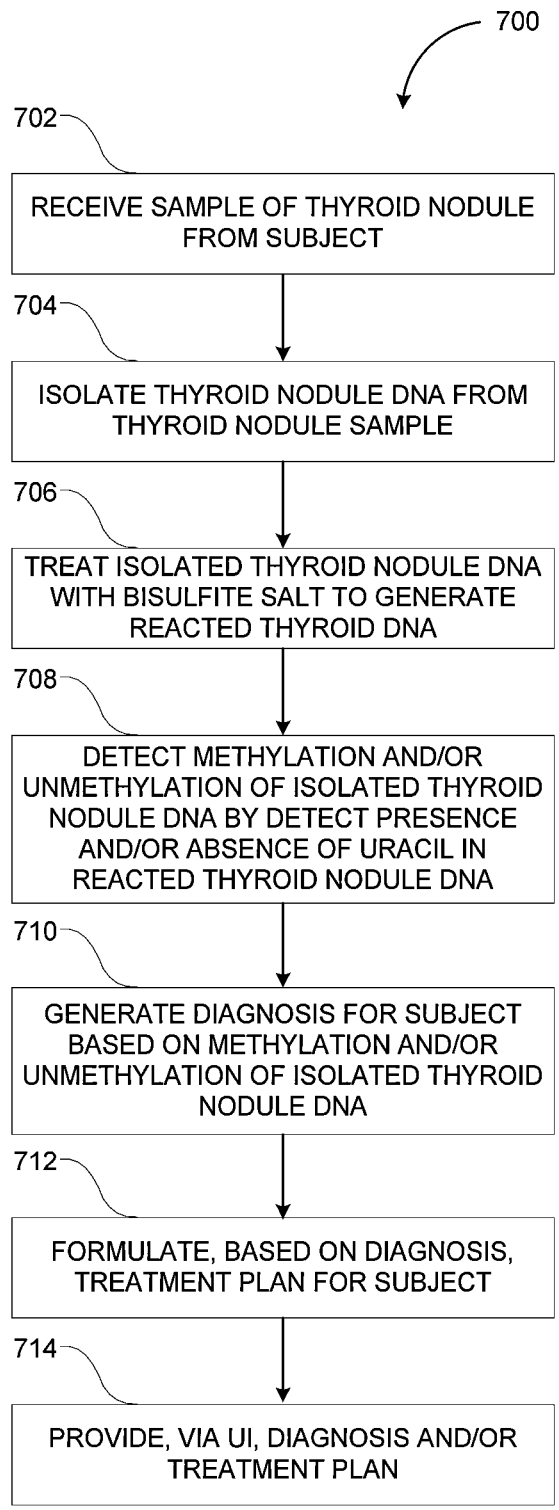
FIG. 5 depicts a flowchart illustrating an exemplary process for diagnosing thyroid cancer.

FIG. 5 depicts a flowchart illustrating an exemplary process 700 for diagnosing thyroid cancer. Referring to FIGS. 4-5, the process 700 can be performed by the thyroid cancer diagnostic system 600.

The thyroid cancer diagnostic system 600 (e.g., the input module 610) can receive a sample of a thyroid nodule from a subject (702). The thyroid cancer diagnostic system 600 (e.g., the isolation module 612) can isolate thyroid nodule DNA from the thyroid nodule sample (704). The thyroid cancer diagnostic system 600 (e.g., the conversion module 614) can treat the isolated thyroid nodule DNA with a bisulfite salt to generate reacted thyroid nodule DNA (706). Treating the isolated thyroid nodule DNA with the bisulfite salt can form a reacted thyroid nodule DNA by converting the cytosine present in the isolated thyroid nodule DNA to uracil. In embodiments, the thyroid cancer diagnostic system 600 can further process the reacted thyroid nodule DNA by desulphonating, cleansing, and/or amplifying the reacted thyroid nodule DNA.

The thyroid cancer diagnostic system 600 (e.g., the detection module 616) can detect methylation and/or unmethylation of the isolated thyroid nodule DNA by at least detecting a presence and/or absence of uracil in the reacted thyroid nodule DNA (708). In embodiments, the thyroid cancer diagnostic system 600 can be configured to detect a presence and/or absence of uracil at specific methylation sites (e.g., as set forth in Table 1). Moreover, the thyroid cancer diagnostic system 600 can be configured to detect a level of methylation and/or unmethylation at the methylation sites.

The thyroid cancer diagnostic system 600 (e.g., the diagnostics module 618) can generate a diagnosis for the subject based on the methylation and/or unmethylation of the isolated thyroid nodule DNA (710). For example, the thyroid cancer diagnostic system 600 can generate a diagnosis based on a level of methylation and/or unmethylation at a plurality of specific methylation sites. Each methylation site may be associated with a certain threshold unmethylation level (e.g., as set forth in Table 2). As such, the thyroid cancer diagnostic system 600 can determine that the thyroid nodule from the subject is malignant (e.g., cancerous) if the level of unmethylation at the plurality of methylation sites exceeds the corresponding thresholds.

The thyroid cancer diagnostic system 600 (e.g., the treatment module 620) can formulate, based on the diagnosis, a treatment plan for the subject (712). For example, when the diagnosis indicates that a presence and/or risk of malignant thyroid nodules in the subject, the thyroid cancer diagnostic system 600 can prescribe thyroid surgery, radiation therapy, radioactive iodine therapy, chemotherapy, thyroid hormone therapy, and/or administration of an active agent. The thyroid cancer diagnostic system 600 (e.g., the UI module 622) can provide, via a UI (e.g., GUI at the device 630), the diagnosis and/or the treatment plan for the subject (714).

Figure 6:
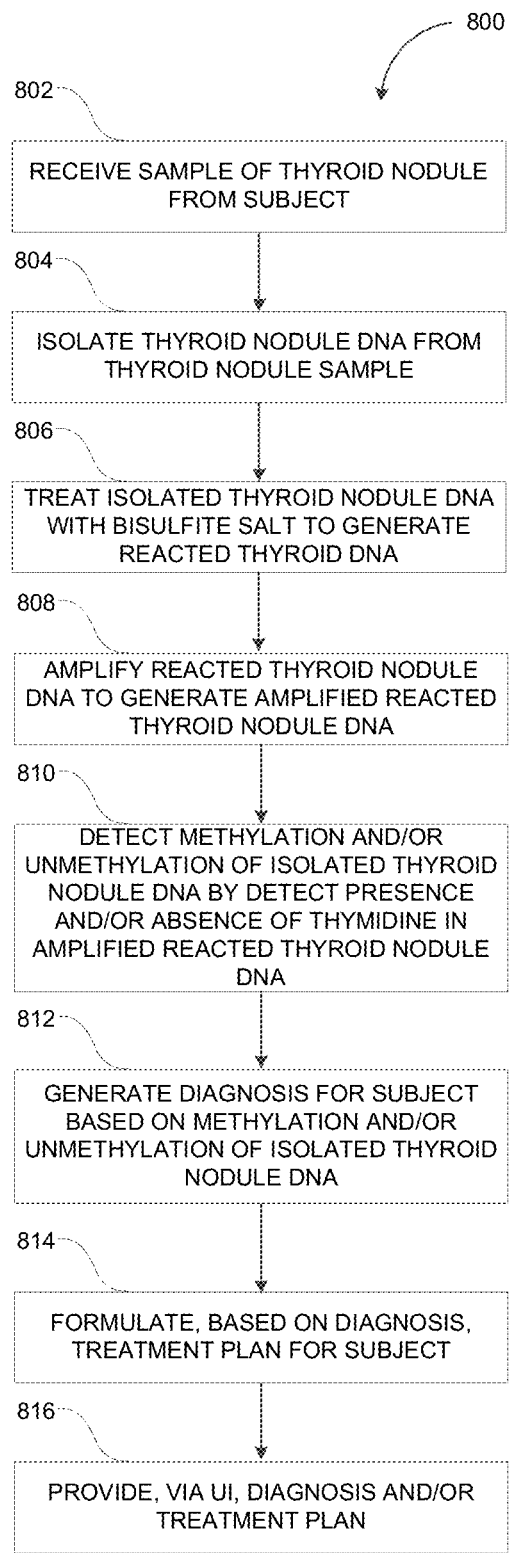
FIG. 6 depicts a flowchart illustrating an exemplary process for diagnosing thyroid cancer.

FIG. 6 depicts a flowchart illustrating an exemplary process 800 for diagnosing thyroid cancer. Referring to FIGS. 4 and 6, the process 700 can be performed by the thyroid cancer diagnostic system 600.

The thyroid cancer diagnostic system 600 (e.g., the input module 610) can receive a sample of a thyroid nodule from a subject (802). The thyroid cancer diagnostic system 600 (e.g., the isolation module 612) can isolate thyroid nodule DNA from the thyroid nodule sample (804). The thyroid cancer diagnostic system 600 (e.g., the conversion module 614) can treat the isolated thyroid nodule DNA with a bisulfite salt to generate reacted thyroid nodule DNA (806).

As shown in FIG. 6, the thyroid cancer diagnostic system 600 (e.g., the conversion module 614) can amplify the reacted thyroid nodule DNA (808). For instance, the thyroid cancer diagnostic system 600 can amplify the reacted thyroid nodule DNA subsequent to treating the isolated thyroid nodule NA with the bisulfite salt to generate the reacted thyroid nodule DNA. The thyroid cancer diagnostic system 600 can detect methylation and/or unmethylation of the isolated thyroid nodule DNA by detecting a presence and/or absence of thymidine in the amplified reacted thyroid nodule DNA (810).

The thyroid cancer diagnostic system 600 (e.g., the diagnostics module 618) can generate a diagnosis for the subject based on the methylation and/or unmethylation of the isolated thyroid nodule DNA (812). Moreover, the thyroid cancer diagnostic system 600 (e.g., the treatment module 620) can formulate, based on the diagnosis, a treatment plan for the subject (814). The thyroid cancer diagnostic system 600 (e.g., the UI module 622) can provide, via a UI, the diagnosis and/or treatment plan for the subject.

It should be appreciated that the process 700 and/or 800 can include different and/or additional operations without departing from the scope of the present subject matter. Moreover, one or more operations of the process 700 and/or 800 can be omitted and/or repeated without departing from the scope of the present subject matter.

Implementations of the present subject matter can include, but are not limited to, methods consistent with the descriptions provided above as well as articles that comprise a tangibly embodied machine-readable medium operable to cause one or more machines (e.g., computers, etc.) to result in operations implementing one or more of the described features. Similarly, computer systems are also described that can include one or more processors and one or more memories coupled to the one or more processors. A memory, which can include a computer-readable storage medium, can include, encode, store, or the like one or more programs that cause one or more processors to perform one or more of the operations described herein. Computer implemented methods consistent with one or more implementations of the current subject matter can be implemented by one or more data processors residing in a single computing system or multiple computing systems. Such multiple computing systems can be connected and can exchange data and/or commands or other instructions or the like via one or more connections, including but not limited to a connection over a network (e.g. the Internet, a wireless wide area network, a local area network, a wide area network, a wired network, or the like), via a direct connection between one or more of the multiple computing systems, etc.

One or more aspects or features of the subject matter described herein can be realized in digital electronic circuitry, integrated circuitry, specially designed ASICs, FPGAs, computer hardware, firmware, software, and/or combinations thereof. These various aspects or features can include implementation in one or more computer programs that are executable and/or interpretable on a programmable system including at least one programmable processor, which can be special or general purpose, coupled to receive data and instructions from, and to transmit data and instructions to, a storage system, at least one input device, and at least one output device. The programmable system or computing system can include clients and servers. A client and server are generally remote from each other and typically interact through a communication network. The relationship of client and server arises by virtue of computer programs running on the respective computers and having a client-server relationship to each other.

These computer programs, which can also be referred to programs, software, software applications, applications, components, or code, include machine instructions for a programmable processor, and can be implemented in a high-level procedural language, an object-oriented programming language, a functional programming language, a logical programming language, and/or in assembly/machine language. As used herein, the term "machine-readable medium" refers to any computer program product, apparatus and/or device, such as for example magnetic discs, optical disks, memory, and Programmable Logic Devices (PLDs), used to provide machine instructions and/or data to a programmable processor, including a machine-readable medium that receives machine instructions as a machine-readable signal. The term "machine-readable signal" refers to any signal used to provide machine instructions and/or data to a programmable processor. The machine-readable medium can store such machine instructions non-transitorily, such as for example as would a non-transient solid-state memory or a magnetic hard drive or any equivalent storage medium. The machine-readable medium can alternatively or additionally store such machine instructions in a transient manner, such as for example as would a processor cache or other random access memory associated with one or more physical processor cores.

To provide for interaction with a user, one or more aspects or features of the subject matter described herein can be implemented on a computer having a display device, such as for example a cathode ray tube (CRT) or a liquid crystal display (LCD) or a light emitting diode (LED) monitor for displaying information to the user and a keyboard and a pointing device, such as for example a mouse or a trackball, by which the user may provide input to the computer. Other kinds of devices can be used to provide for interaction with a user as well. For example, feedback provided to the user can be any form of sensory feedback, such as for example visual feedback, auditory feedback, or tactile feedback; and input from the user can be received in any form, including, but not limited to, acoustic, speech, or tactile input. Other possible input devices include, but are not limited to, touch screens or other touch-sensitive devices such as single or multi-point resistive or capacitive trackpads, voice recognition hardware and software, optical scanners, optical pointers, digital MRI image capture devices and associated interpretation software, and the like.

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

EMBODIMENTS

Embodiments include embodiments P1 to P41 following.

Embodiment P1. A method of detecting methylation or unmethylation of a thyroid nodule DNA of a subject, the method comprising: (i) isolating DNA from a thyroid nodule of said subject thereby forming isolated thyroid nodule DNA, (ii) contacting said isolated thyroid nodule DNA with sodium bisulfite thereby forming a reacted thyroid nodule DNA, (iii) detecting the presence or absence of uracil in said reacted thyroid nodule DNA at a methylation site set forth in Table 1, thereby detecting methylation or unmethylation of said thyroid nodule DNA of said subject.

Embodiment P2. The method of embodiment P1, further comprising determining alteration in methylation at a plurality of methylation sites set forth in Table 1.

Embodiment P3. The method of embodiment P2, said alteration comprises increase or loss of uracil level at said plurality of methylation sites.

Embodiment P4. The method of embodiment P3, wherein said uracil level is above a threshold as set forth in Table 2.

Embodiment P5. The method of embodiment P3, wherein said uracil level is above a threshold as set forth in Table 3.

Embodiment P6. The method of embodiment P3, wherein said uracil level is below a threshold as set forth in Table 4.

Embodiment P7. The method of embodiment P3, wherein said subject is a candidate thyroid cancer patient.

Embodiment P8. The method of embodiment P4, wherein said above threshold identifies said thyroid nodule as a cancerous thyroid nodule.

Embodiment P9. The method of embodiment P5, wherein said above threshold identifies said thyroid nodule as a benign thyroid nodule.

Embodiment P10. The method of embodiment P6, wherein said below threshold identifies said thyroid nodule as a benign thyroid nodule.

Embodiment P11. The method of one of the above embodiments, wherein said thyroid nodule is a specimen obtained by biopsy or by surgical resection of said subject.

Embodiment P12. The method of embodiment P11, wherein said subject has undergone thyroid surgery, radiation therapy, radioactive iodine therapy, chemotherapy, thyroid hormone therapy, and administration of an active agent.

Embodiment P13. The method of embodiment P12, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and Vandetanib.

Embodiment P14. A method of determining a thyroid cancer or risk of developing thyroid cancer in a subject in need thereof, said method comprising: (i) isolating DNA from a thyroid nodule of said subject thereby forming isolated thyroid nodule DNA; (ii) contacting said isolated thyroid nodule DNA with sodium bisulfite thereby forming a reacted thyroid nodule DNA; and (iii) detecting the presence or absence of uracil in said reacted thyroid nodule DNA at a methylation site set forth in Table 1; thereby determining said thyroid cancer in said subject.

Embodiment P15. The method of embodiment P14, further comprising selecting a subject that has or is at risk for developing thyroid cancer.

Embodiment P16. The method of embodiment P14, further comprising determining alteration in methylation at a plurality of methylation sites set forth in Table 1.

Embodiment P17. The method of embodiment P16, said alteration comprises increase or loss of uracil level at said plurality of methylation sites.

Embodiment P18. The method of embodiment P17, wherein said uracil level is above a threshold as set forth in Table 2.

Embodiment P19. The method of embodiment P17, wherein said uracil level is above a threshold as set forth in Table 3.

Embodiment P20. The method of embodiment P17, wherein said uracil level is below a threshold as set forth in Table 4.

Embodiment P21. The method of embodiment P17, wherein said subject is a candidate thyroid cancer patient.

Embodiment P22. The method of embodiment P18, wherein said above threshold identifies said thyroid nodule as a cancerous thyroid nodule.

Embodiment P23. The method embodiment P19, wherein said above threshold identifies said thyroid nodule as a benign thyroid nodule.

Embodiment P24. The method of embodiment P20, wherein said below threshold identifies said thyroid nodule as a benign thyroid nodule.

Embodiment P25. The method of embodiments P14-P24, wherein said thyroid nodule is a specimen obtained by biopsy or by surgical resection of said subject.

Embodiment P26. The method of embodiment P25, wherein said subject has undergone thyroid surgery, radiation therapy, radioactive iodine therapy, chemotherapy, thyroid hormone therapy, and administration of an active agent, before said determination.

Embodiment P27. The method of embodiment P26, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and Vandetanib.

Embodiment P28. A method of treating thyroid cancer in a subject determined by the method as set forth in embodiment P22, comprising administering to said subject an active agent for treating thyroid cancer.

Embodiment P29. The method of embodiment P28, wherein said subject has undergone surgery, radiation therapy, radioactive iodine therapy, chemotherapy, or thyroid hormone therapy, before said detection of embodiment 14 at (iii).

Embodiment P30. The method of embodiment P29, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and Vandetanib.

Embodiment P31. The method of one of above embodiments, wherein said subject has or is at risk of papillary thyroid cancer, follicular thyroid cancer, medullary thyroid cancer, or anaplastic thyroid cancer.

Embodiment P32. A deoxyribonucleic acid 5 to 100 nucleotides in length comprising a uracil-containing sequence identical to at least a 5 contiguous nucleotide sequence within a sequence chosen from SEQ ID NO:1 to SEQ ID NO:550.

Embodiment P33. The deoxyribonucleic acid of embodiment P32 identical to 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 of contiguous nucleotide sequence of said sequence chosen from SEQ ID NO: 1 to SEQ ID NO:550.

Embodiment P34. The deoxyribonucleic acid of embodiment P32 or P33, wherein said sequence comprises a methylation site set forth in Table 2.

Embodiment P35. The deoxyribonucleic acid of embodiment P34, wherein a plurality of methylation sites set forth in Table 2 are methylated or unmethylated.

Embodiment P36. A deoxyribonucleic acid chosen from SEQ ID NO:551 to SEQ ID NO: 782, wherein said nucleic acid is hybridized to a complementary DNA sequence comprising uridine or cytosine.

Embodiment P37. The deoxyribonucleic acid of embodiment P36, further comprising an enzyme in a complex with said hybridized complementary DNA sequence.

Embodiment P38. The deoxyribonucleic acid of embodiment P37, wherein said enzyme is Taq polymerase.

Embodiment P39. A kit comprising 322 nucleic acids each independently comprising SEQ ID NO:551 to SEQ ID NO:782, wherein said nucleic acids do not simultaneously comprise the same SEQ ID NO:551 to SEQ ID NO:782.

Embodiment P40. The kit according to embodiment P39, further comprising: enzymes, reagents for deamination of cytosine, buffers, vials, plasmid vectors, control DNA, devices for collecting thyroid tissue samples, reagents for isolating DNA, reagents for labeling DNA, or any combinations thereof.

Embodiment P41. The kit according to embodiment P40, wherein the enzymes are selected from the group consisting of: thermostable DNA polymerase enzymes, restriction enzymes, and combination thereof.

Further embodiments include embodiments 1-58 following.

Embodiment 1. A method of detecting methylation or unmethylation of a thyroid nodule DNA molecule of a subject, the method comprising: (i) isolating a thyroid nodule DNA molecule from a thyroid nodule of said subject thereby forming an isolated thyroid nodule DNA molecule, (ii) contacting said isolated thyroid nodule DNA molecule with a bisulfite salt thereby forming a reacted thyroid nodule DNA molecule, (iii) detecting the presence or absence of uracil in said reacted thyroid nodule DNA molecule at a methylation site set forth in Table 1, thereby detecting methylation or unmethylation of said thyroid nodule DNA molecule of said subject.

Embodiment 2. The method of embodiment 1, further comprising detecting the presence or absence of uracil in said reacted thyroid nodule DNA molecule at a plurality of methylation sites set forth in Table 1, wherein said methylation site forms a part of said plurality of methylation sites.

Embodiment 3. The method of embodiment 1, the method further comprising: (i) isolating a plurality of thyroid nodule DNA molecules from said thyroid nodule of said subject thereby forming a plurality of isolated thyroid nodule DNA molecules, wherein said isolated thyroid nodule DNA molecule forms part of said plurality of isolated thyroid nodule DNA molecules, (ii) contacting said plurality of isolated thyroid nodule DNA molecules with said bisulfite salt thereby forming a plurality of reacted thyroid nodule DNA molecules, wherein said reacted thyroid nodule DNA molecule forms part of said plurality of reacted thyroid nodule DNA molecules, (iii) detecting the level of reacted thyroid nodule DNA molecules in said plurality of reacted thyroid nodule DNA molecules having a uracil at a methylation site set forth in Table 1, thereby detecting the level of methylation or unmethylation in said plurality of thyroid nodule DNA molecules of said subject.

Embodiment 4. The method of embodiment 3, further comprising determining the level of uracil in said reacted thyroid nodule DNA molecule at a plurality methylation sites set forth in Table 1, wherein said methylation site forms a part of said plurality of methylation sites.

Embodiment 5. The method of embodiment 4, wherein said uracil level is above a threshold as set forth in Table 2.

Embodiment 6. The method of embodiment 4, wherein said uracil level is above a threshold as set forth in Table 3.

Embodiment 7. The method of embodiment 4, wherein said uracil level is below a threshold as set forth in Table 4.

Embodiment 8. The method of one of the above embodiments, wherein said subject is suspected of having thyroid cancer.

Embodiment 9. The method of one of the above embodiments, wherein said thyroid nodule is a specimen obtained by biopsy or by surgical resection of said subject.

Embodiment 10. The method of one of the above embodiments, wherein said subject has undergone thyroid surgery, radiation therapy, radioactive iodine therapy, chemotherapy, thyroid hormone therapy, and/or administration of an active agent.

Embodiment 11. The method of embodiment 10, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and/or Vandetanib.

Embodiment 12. A method of detecting a thyroid cancer or risk of developing thyroid cancer in a subject in need thereof, said method comprising:

(i) isolating a thyroid nodule DNA molecule from a thyroid nodule of said subject thereby forming an isolated thyroid nodule DNA molecule;

(ii) contacting said isolated thyroid nodule DNA molecule with a bisulfite salt thereby forming a reacted thyroid nodule DNA molecule; and (iii) detecting the presence or absence of uracil in said reacted thyroid nodule DNA molecule at a methylation site set forth in Table 1; thereby detecting said thyroid cancer in said subject.

Embodiment 13. The method of embodiment 12, wherein said subject (a) is a woman; (b) is about 20 to about 55 years old; (c) has a mutated Ret Proto-Oncogene; (d) has a grandparent, parent, or sibling who has been diagnosed with thyroid cancer; (e) self-identifies as being Caucasian or Asian; and/or (f) has or has had breast cancer.

Embodiment 14. The method of embodiment 12, further comprising detecting the presence or absence of uracil in said reacted thyroid nodule DNA molecule at a plurality of methylation sites set forth in Table 1, wherein said methylation site forms a part of said plurality of methylation sites.

Embodiment 15. The method of embodiment 12, the method further comprising: (i) isolating a plurality of thyroid nodule DNA molecules from said thyroid nodule of said subject thereby forming a plurality of isolated thyroid nodule DNA molecules, wherein said isolated thyroid nodule DNA molecule forms part of said plurality of isolated thyroid nodule DNA molecules, (ii) contacting said plurality of isolated thyroid nodule DNA molecules with said bisulfite salt thereby forming a plurality of reacted thyroid nodule DNA molecules, wherein said reacted thyroid nodule DNA molecule forms part of said plurality of reacted thyroid nodule DNA molecules, (iii) detecting the level of reacted thyroid nodule DNA molecules in said plurality of reacted thyroid nodule DNA molecules having a uracil at a methylation site set forth in Table 1; thereby detecting said thyroid cancer in said subject.

Embodiment 16. The method of embodiment 15, further comprising determining the level of uracil in said reacted thyroid nodule DNA molecule at a plurality methylation sites set forth in Table 1, wherein said methylation site forms a part of said plurality of methylation sites.

Embodiment 17. The method of embodiment 16, wherein said uracil level is above a threshold as set forth in Table 2.

Embodiment 18. The method of embodiment 16, wherein said uracil level is above a threshold as set forth in Table 3.

Embodiment 19. The method of embodiment 16, wherein said uracil level is below a threshold as set forth in Table 4.

Embodiment 20. The method of one of the above embodiments, wherein said subject is suspected of having thyroid cancer.

Embodiment 21. The method of one of the above embodiments, wherein said thyroid nodule is a specimen obtained by biopsy or by surgical resection of said subject.

Embodiment 22. The method of one of the above embodiments, wherein said subject has undergone thyroid surgery, radiation therapy, radioactive iodine therapy, chemotherapy, thyroid hormone therapy, and administration of an active agent, before said determination.

Embodiment 23. The method of embodiment 22, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and.

Embodiment 24. A method of treating thyroid cancer in a subject determined by the method as set forth in any of embodiments 12 to 23, comprising administering to said subject an active agent for treating thyroid cancer.

Embodiment 25. The method of embodiment 24, wherein said subject has undergone surgery, radiation therapy, radioactive iodine therapy, chemotherapy, or thyroid hormone therapy, before said detection of claim 12 at (iii).

Embodiment 26. The method of embodiment 25, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and Vandetanib.

Embodiment 27. The method of one of the above embodiments, wherein said subject has or is at risk of papillary thyroid cancer, follicular thyroid cancer, medullary thyroid cancer, or anaplastic thyroid cancer.

Embodiment 28. The method of one of the above embodiments, wherein said bisulfite salt is sodium bisulfite.

Embodiment 29. The method of one of the above embodiments, further comprising determining a papillary thyroid carcinoma (PTC) methylation alteration score for said subject, wherein the PTC methylation alteration score is equal to: the number of methylation sites in Table I having a uracil level equal to or greater than the corresponding threshold level set forth in Table 2.

Embodiment 30. The method of one of the above embodiments, further comprising determining a benign thyroid nodule (BTN) methylation alteration score for said subject, wherein the BTN methylation alteration score is equal to:

(a) the number of methylation sites in Table 1 having a uracil level equal to or greater than the corresponding threshold level set forth in Table 3;

(b) the number of methylation sites in Table 1 having a uracil level equal to or less than the corresponding threshold level set forth in Table 4; or (c) the number of methylation sites in Table 1 having a uracil level equal to or greater than the corresponding threshold level set forth in Table 3 plus the number of methylation sites in Table 1 having a uracil level equal to or less than the corresponding threshold level set forth in Table 4.

Embodiment 31. The method of embodiment 29, further comprising calculating a Composite Cancer Risk Score for said subject.

Embodiment 32. The method of embodiment 31, wherein said Composite Cancer Risk Score for said subject equals:

[the PTC methylation alteration score for said subject]/[BTN methylation alteration score for said subject].

Embodiment 33. The method of embodiment 31, wherein said Composite Cancer Risk Score for said subject equals:

[(the PTC methylation alteration score for said subject)+1]/[(BTN methylation alteration score for said subject)+1].

Embodiment 34. The method of one of embodiments 29 to 33, wherein said subject is identified as being at risk of developing thyroid cancer or diagnosed as having thyroid cancer if (a) the PTC methylation alteration score for said subject is at least 5, 6, 7, 8, 9, or 10; (b) the BTN methylation alteration score for said subject is at least 5, 6, 7, 8, 9, or 10; and/or (c) the Composite Cancer Risk Score for said subject is at least about 2, 2.1, 2.2, 2.3, 2.4, 2.5, 2.6, 2.7, 2.8, 2.9, or 3.0.

Embodiment 35. The method of one of embodiments 29 to 33, wherein said subject is treated for thyroid cancer or directed to receive additional screening for thyroid cancer if (a) the PTC methylation alteration score for said subject is at least 5, 6, 7, 8, 9, or 10; (b) the BTN methylation alteration score for said subject is at least 5, 6, 7, 8, 9, or 10; and/or (c) the Composite Cancer Risk Score for said subject is at least about 2, 2.1, 2.2, 2.3, 2.4, 2.5, 2.6, 2.7, 2.8, 2.9, or 3.0.

Embodiment 36. A deoxyribonucleic acid at least 5 to 100 nucleotides in length comprising a uracil-containing sequence that is identical to a sequence of at least a 5 contiguous nucleotides within a sequence chosen from SEQ ID NO:1 to SEQ ID NO:550.

Embodiment 37. The deoxyribonucleic acid of embodiment 36, comprising a uracil-containing sequence that is identical to a sequence of at least 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 contiguous nucleotides within said sequence chosen from SEQ ID NO:1 to SEQ ID NO:550.

Embodiment 38. The deoxyribonucleic acid of embodiment 36 or 37, wherein said sequence comprises a methylation site set forth in Table 1.

Embodiment 39. The deoxyribonucleic acid of one of embodiments 36 to 38, wherein a plurality of methylation sites set forth in Table 1 contain a uracil or a cytosine.

Embodiment 40. A deoxyribonucleic acid chosen from SEQ ID NO:551 to SEQ ID NO: 782, wherein said nucleic acid is hybridized to a complementary DNA sequence comprising uridine or cytosine.

Embodiment 41. The deoxyribonucleic acid of embodiment 40, further comprising an enzyme in a complex with said hybridized complementary DNA sequence.

Embodiment 42. The deoxyribonucleic acid of embodiment 41, wherein said enzyme is Taq polymerase.

Embodiment 43. A kit comprising a plurality of nucleic acids each independently comprising SEQ ID NO:551 to SEQ ID NO:782, wherein each nucleic acid of said plurality is unique.

Embodiment 44. The kit according to embodiment 43, further comprising: an enzyme, a reagent for deamination of cytosine, a buffer, a vial, a plasmid vector, a control DNA, a device for collecting a thyroid tissue sample, a reagent for isolating DNA, a reagent for labeling DNA, or any combination thereof.

Embodiment 45. The kit according to embodiment 44, wherein the enzyme comprises a thermostable DNA polymerase enzyme and/or a restriction enzyme.

Embodiment 46. A system for detecting methylation or unmethylation of a thyroid nodule deoxyribonucleic acid (DNA) of a subject, the system comprising:
 at least one processor; and
 at least one memory including program code which when executed by the at least one memory provides operations comprising:
 isolating a thyroid nodule DNA molecule from a thyroid nodule of said subject thereby forming an isolated thyroid nodule DNA molecule;
 contacting said isolated thyroid nodule DNA molecule with a bisulfite salt thereby forming a reacted thyroid nodule DNA molecule;
 detecting the presence or absence of uracil in said reacted thyroid nodule DNA molecule at a methylation site set forth in Table 1, thereby detecting methylation or unmethylation of said thyroid nodule DNA molecule of said subject;
 generating a diagnosis for said subject based at least in part on the presence or absence of uracil in said reacted thyroid nodule DNA molecule at the methylation site set forth in Table 1; and
 providing, via a user interface, the diagnosis for said subject.

Embodiment 47. The system of embodiment 46, wherein the system is further configured to detect the presence or absence of uracil in said reacted thyroid nodule DNA molecule at a plurality of methylation sites set forth in Table 1, wherein said methylation site forms a part of said plurality of methylation sites.

Embodiment 48. The system of embodiment 46, wherein the system is further configured to: (i) isolate a plurality of thyroid nodule DNA molecules from said thyroid nodule of said subject thereby forming a plurality of isolated thyroid nodule DNA molecules, wherein said isolated thyroid nodule DNA molecule forms part of said plurality of isolated thyroid nodule DNA molecules, (ii) contact said plurality of isolated thyroid nodule DNA molecules with said bisulfite salt thereby forming a plurality of reacted thyroid nodule DNA molecules, wherein said reacted thyroid nodule DNA molecule forms part of said plurality of reacted thyroid nodule DNA molecules, (iii) detect the level of reacted thyroid nodule DNA molecules in said plurality of reacted thyroid nodule DNA molecules having a uracil at a methylation site set forth in Table 1, thereby detecting the level of methylation or unmethylation in said plurality of thyroid nodule DNA molecules of said subject.

Embodiment 49. The system of embodiment 48, wherein the system is further configured to detect the level of uracil in said reacted thyroid nodule DNA molecule at a plurality methylation sites set forth in Table 1, wherein said methylation site forms a part of said plurality of methylation sites.

Embodiment 50. The system of embodiment 49, wherein said uracil level is above a threshold as set forth in Table 2.

Embodiment 51. The system of embodiment 49, wherein said uracil level is above a threshold as set forth in Table 3.

Embodiment 52. The system of embodiment 49, wherein said uracil level is below a threshold as set forth in Table 4.

Embodiment 53. The system of embodiment 49, wherein said subject is a candidate thyroid cancer patient.

Embodiment 54. The system of one of embodiments 46 to 53, wherein said thyroid nodule is a specimen obtained by biopsy or by surgical resection of said subject.

Embodiment 55. The system of one of embodiments 46 to 54, wherein said subject has undergone thyroid surgery, radiation therapy, radioactive iodine therapy, chemotherapy, thyroid hormone therapy, and/or administration of an active agent.

Embodiment 56. The system of embodiment 55, wherein said active agent is chosen from Cabozantinib-S-Malate, Caprelsa (Vandetanib), Cometriq (Cabozantinib-S-Malate), Doxorubicin Hydrochloride, Lenvatinib Mesylate, Lenvima (Lenvatinib Mesylate), Nexavar (Sorafenib Tosylate), Sorafenib Tosylate, and Vandetanib.

Embodiment 57. The system of one of embodiments 46 to 56, wherein the system is further configured to:
 formulate, based at least in part on the diagnosis, a treatment plan for said subject; and
 provide, via the user interface, the treatment plan.

Embodiment 58. The system of embodiment 57, wherein the treatment plan includes one or more of thyroid surgery, radiation therapy, radioactive iodine therapy, chemotherapy, thyroid hormone therapy, and administration of an active agent.

EXAMPLES

Example 1

Human frozen specimens were blindly evaluated by a pathologist. In the study, 28 benign nodules and 40 thyroid cancer specimens were analyzed.

DNA Methylation Profiling

Genomic DNA was isolated by using a standard phenol/chloroform extraction approach followed by ethanol precipitation. Further, genomic DNA underwent Reduced Representation Bisulfite Sequencing (RRBS) procedure. RRBS DNA amplicons were paired-end sequenced by using Hiseq 2500 (Illumina). For each sample, at least 15 million aligned reads were obtained. BTN and PTC specific signatures were determined based on cytosines which are characterized by at least 5 sequencing reads in each sample.

Identification of BTN Specific and PTC Specific DNA Methylation Changes

Figure 1A:
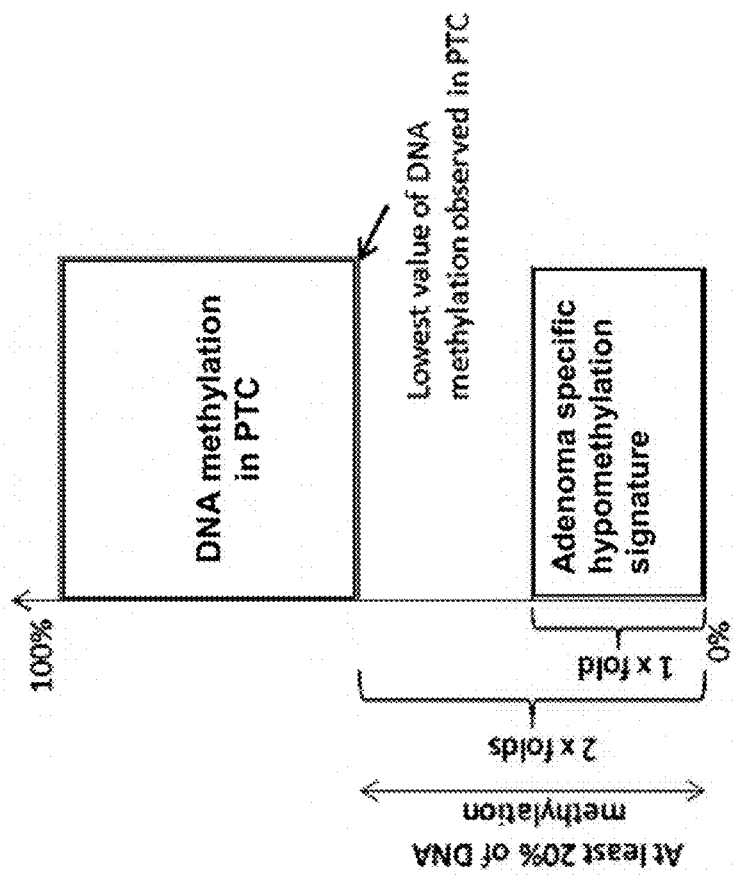

DNA methylation patterns were analyzed in 114 thyroid specimens including 28 benign nodules, 40 thyroid cancer, and 46 adjacent normal thyroid tissues, to identify the presence of thyroid cancer specific and benign nodule specific signatures. After genome alignment, a search was performed for DNA regions which have BTN or PTC specific alterations. For identification of a DNA region with a BTN specific loss of DNA methylation, DNA regions were identified which had a DNA methylation level in at least 6 out 28 that was at least 2-fold less than the level of methylation in the same DNA region any analyzed PTC specimen; where the lowest value of DNA methylation at this DNA region among all PTC specimens is 20% or higher (FIG. 1A). For identification of DNA regions with BTN specific DNA methylation accumulation, the following criteria were used: a level of DNA methylation in an individual BTN that is at least 2-fold higher than the level of DNA methylation in the same DNA region in any analyzed PTC; where the value of DNA methylation of analyzed BTN specimen is at least 20% or more greater (FIG. 1B). The BTN signature includes DNA regions which were affected by DNA methylation loss in at least 6 out 28 analyzed BTN samples and regions which were affected by DNA methylation accumulation in at least 6 out 28 analyzed BTN samples.

Further, regions were determined which undergo PTC specific DNA methylation alterations. The criteria for the identification of DNA regions with a PTC specific loss of DNA methylation, was: a level of DNA methylation in 6 out of 46 PTC that is 2-fold less than in any analyzed adenoma and any normal matching tissue, where the lowest value of DNA methylation in the region among all non-malignant specimens is 20% or higher. The criteria for the identification of DNA regions with PTC specific DNA methylation accumulation was a level of DNA methylation in an individual PTC that is at least 2-fold higher than the level of methylation in any analyzed adenoma and normal matching tissue, where the value of DNA methylation in analyzed PTC sample should be 20% or higher. There were no DNA regions that were affected by DNA methylation accumulation in at least 6 PTC out 46 analyzed PTC. Therefore, the PTC specific DNA methylation signatures contain only DNA regions which are affected by DNA methylation loss in at least 6 out 46 analyzed PTC.

Figure 2A:
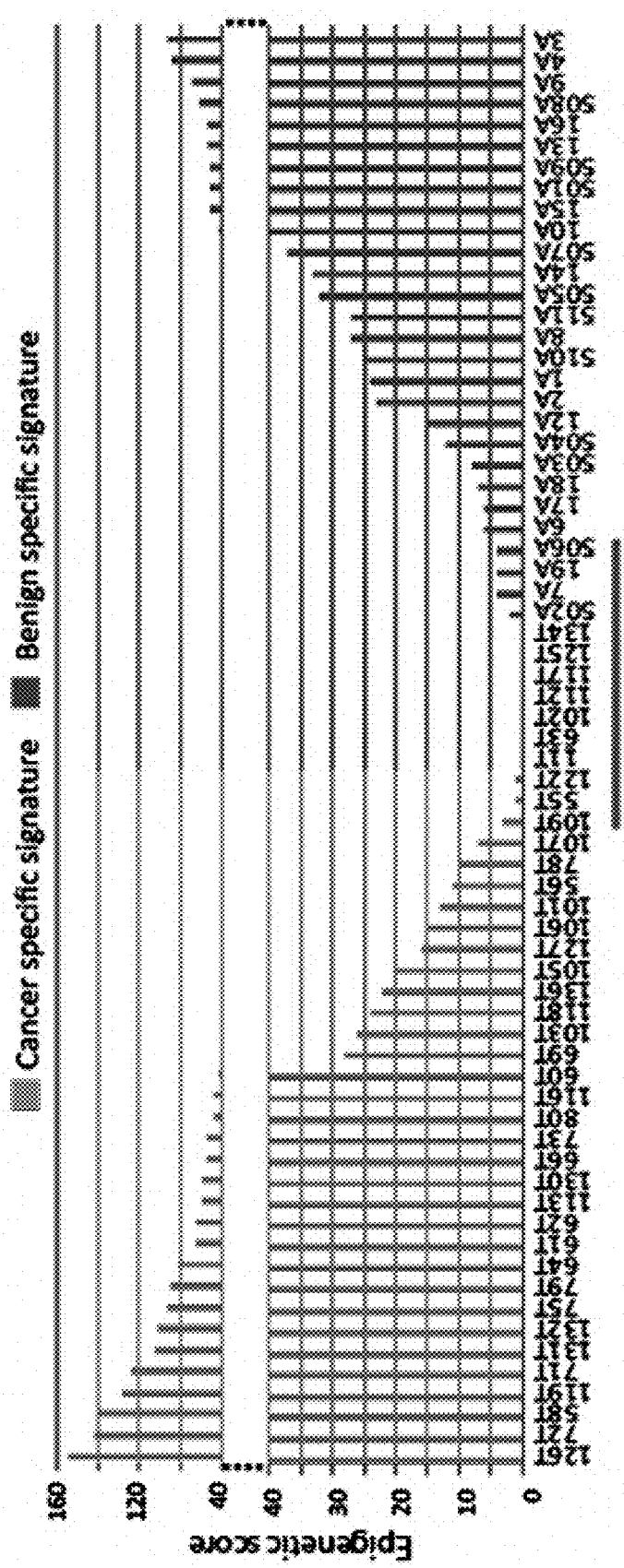
FIGS. 2A and 2B show 364 cytosines associated with BTN or PTC specific DNA methylation changes. Legend (FIG. 2A): Cancer specific signature (gray); benign specific signature (black).

The total number of identified DNA regions which fall in PTC specific or BTN specific signature is 258, which comprises DNA methylation information for 364 cytosines (FIG. 2A). There are 230 cytosines which characterize the PTC signature and 134 cytosines characterizing the BTN signature.

Evaluation of the cancer specific and benign specific changes revealed that 10 out of 40 thyroid cancer specimens are characterized by few (less than 5) or no cancer specific changes, and 4 out 28 benign nodules indicated very few (less than 5) benign specific changes (FIG. 2A). Since the approach described herein is based on the identification of the tissue specific alterations, these specimens were determined to be "epigenetically indeterminate."

Figure 2B:
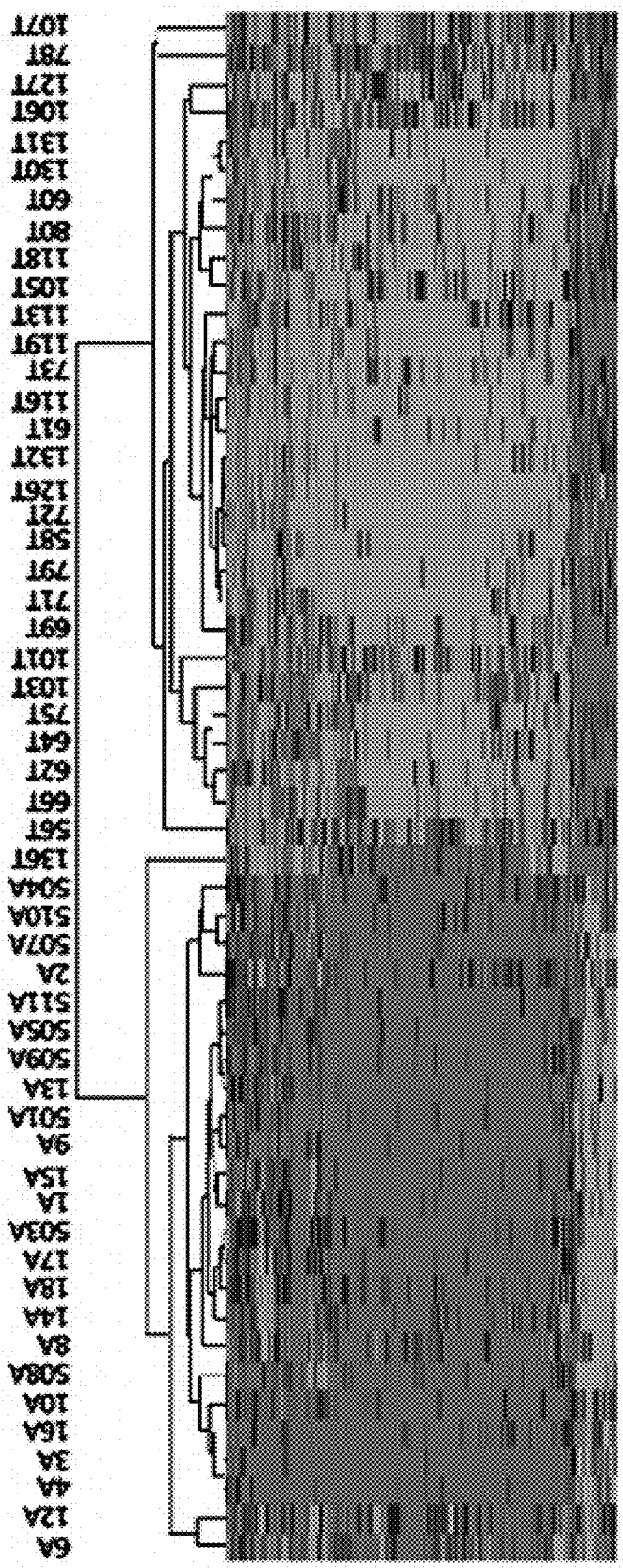

For specimens with a determinate epigenetic state, clustering analysis revealed a strict separation of thyroid cancer from benign nodules based on DNA methylation levels of cytosines associated with benign and cancer scores (FIG. 2B). Thus, the use of benign and cancer scores can provide a unique thyroid nodule diagnostic tool.

Development of Diagnostic Panel Based on BTN/PTC Signature Scores.

The data disclosed herein demonstrates that analysis of DNA methylation of one or more of 258 DNA regions can provide substantial information regarding a presence of malignancy in thyroid samples. Therefore, DNA methylation analysis within BTN and PTC signature can be used as a PTC diagnostic tool. According to the data, PTC diagnosis can be made by using both BTN and PTC signatures. Each signature can be a score based on the number of specific alterations within the signature for each individual sample. For example, the number of BTN specific alterations within BTN signature DNA regions reflects a BTN signature score. At the same time, the number of PTC specific alterations for DNA regions within PTC signature group indicates PTC signature score.

In order to validate the approach disclosed herein and estimate an accuracy of the proposed signatures, a statistical analysis was performed based on the leave-one-out-cross-validation technique. Specifically, cancer and benign scores were determined for each individual nodule by using benign and cancer signatures which were developed based on DNA methylation patterns of the rest of samples excluding the testing sample. In order to predict benign and cancer scores for 68 nodules, 68 benign and cancer unique predictive signatures were developed.

Figure 3A:
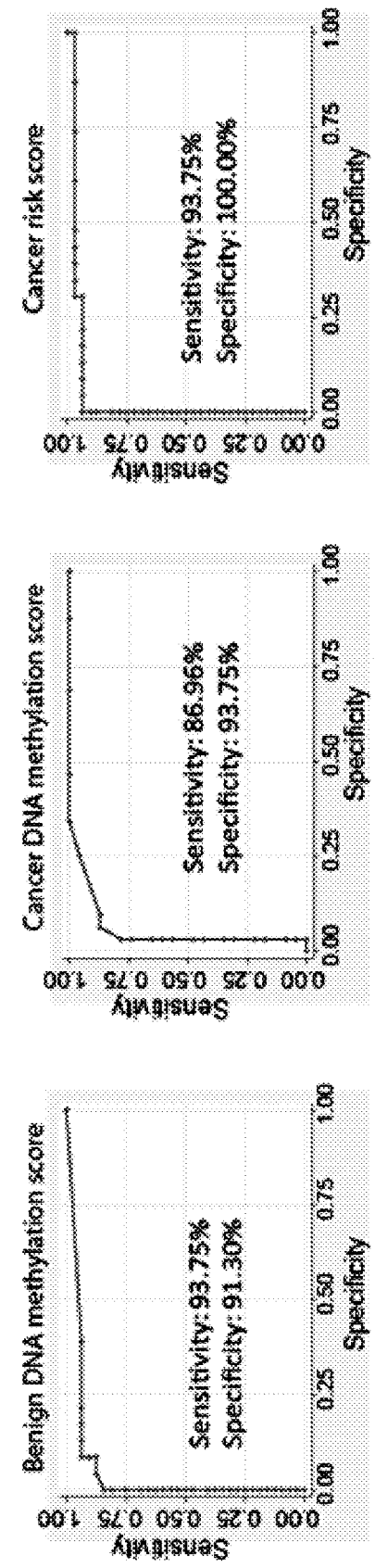
FIGS. 3A-3C depict exemplary thyroid cancer diagnostics based on DNA methylation signatures.

After cross-validation, DNA methylation signatures (score >=5) were observed in 80% (32 out 40) of thyroid cancers and 82% (23 out 28) of benign nodules (FIG. 3A). These specimens with a determinate epigenetic state were used for the further analysis.

According to the cross-validation observations, both, benign and malignant diagnostic scores provided accurate results for thyroid nodule diagnostics (FIG. 3A). However, a combining of benign and malignant scores into a cancer risk score is associated with even higher diagnostic performance. The cancer risk score was calculated using the following equation: Cancer Risk Score=(cancer score+1)/(benign score+1)

Figure 3B:
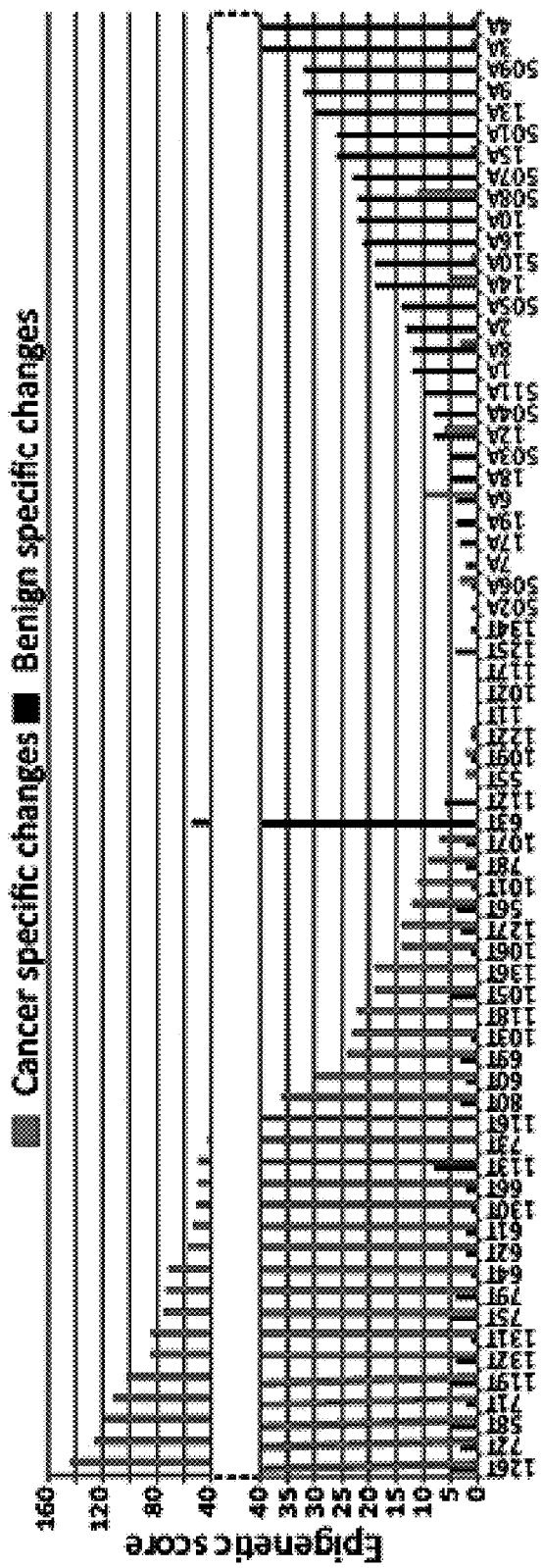

According to the data herein, specimens with cancer risk score above 2.6 represent thyroid cancer and specimens with cancer score below 2.6 are benign nodules. Based on these criteria, all 23 nodules were correctly diagnosed as benign and 30 out 32 thyroid malignancies were diagnosed as a cancer (FIG. 3B). Therefore, the test had a specificity of 100% and a sensitivity of 94%, with a 100% positive predictive value (PPV) and a 92% negative predictive value (NPV). These data suggest that DNA methylation analysis of 258 DNA regions in thyroid specimens can serve as a potential diagnostic tool for the determination of malignancy.

Figure 3C:
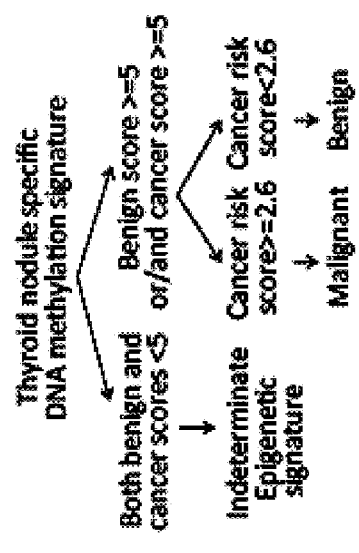

An algorithm for performing a thyroid nodule diagnostic evaluation is shown in FIG. 3C. Specimens with benign and malignant signatures are associated with indeterminate epigenetic state and were excluded from the study. Specimens with a cancer risk score above 2.6 are considered to be malignant, and thyroid nodules with a cancer risk score below 2.6 are considered to be benign.

This scoring approach clearly differentiates benign from malignant specimens. These data suggest that DNA methylation analysis of 258 DNA regions in thyroid specimens, including potentially FNA specimens, can serve as a diagnostic tool for the determination of malignancy.

The data indicates that malignancy of thyroid specimens can be determined by DNA methylation pattern analysis of one or more of 258 different DNA regions.

SEQUENCE LISTING (782 sequences)

SEQ ID NO: 1 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 12: mod_base = OTHER; note = uracil
  modified_base 20: mod_base = OTHER; note = uracil
  modified_base 21: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 64: mod_base = OTHER; note = uracil
  modified_base 69: mod_base = OTHER; note = uracil
  modified_base 72: mod_base = OTHER; note = uracil
  modified_base 75: mod_base = OTHER; note = uracil
  modified_base 80: mod_base = OTHER; note = uracil
  modified_base 82: mod_base = OTHER; note = uracil
  modified_base 97: mod_base = OTHER; note = uracil
  modified_base 108: mod_base = OTHER; note = uracil
  modified_base 125: mod_base = OTHER; note = uracil
  modified_base 132: mod_base = OTHER; note = uracil
  modified_base 138: mod_base = OTHER; note = uracil
  modified_base 140: mod_base = OTHER; note = uracil
  modified_base 145: mod_base = OTHER; note = uracil
  modified_base 148: mod_base = OTHER; note = uracil
  modified_base 152: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 172: mod_base = OTHER; note = uracil
  modified_base 188: mod_base = OTHER; note = uracil
  modified_base 201: mod_base = OTHER; note = uracil
  modified_base 202: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 215: mod_base = OTHER; note = uracil
  modified_base 219: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 252: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 272: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 295: mod_base = OTHER; note = uracil
tttttagtttttygtggygttagagttggttgttttagtagygygtgtttattyggtttaaagttgttttgtagttggttattgtgggagaagagattggaaaagtttaaaggtggagaggyggtagygatttggagtattttttygtaygttgtaatttttgagaagaaataaagaggaaaygaggttgtttagataatttygggttttggtgtttgtatttagaaaaattaggtttttttgaaaaattatagaattatgttgttagtgttaggtttttagataatgatgtgtttgtgt

SEQ ID NO: 2 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 18: mod_base = OTHER; note = uracil
  modified_base 25: mod_base = OTHER; note = uracil
  modified_base 26: mod_base = OTHER; note = uracil
  modified_base 30: mod_base = OTHER; note = uracil
  modified_base 32: mod_base = OTHER; note = uracil
  modified_base 36: mod_base = OTHER; note = uracil
  modified_base 39: mod_base = OTHER; note = uracil
  modified_base 46: mod_base = OTHER; note = uracil
  modified_base 57: mod_base = OTHER; note = uracil
  modified_base 65: mod_base = OTHER; note = uracil
  modified_base 66: mod_base = OTHER; note = uracil
  modified_base 75: mod_base = OTHER; note = uracil
  modified_base 82: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 94: mod_base = OTHER; note = uracil
  modified_base 95: mod_base = OTHER; note = uracil
  modified_base 105: mod_base = OTHER; note = uracil
  modified_base 110: mod_base = OTHER; note = uracil
  modified_base 113: mod_base = OTHER; note = uracil
  modified_base 114: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 132: mod_base = OTHER; note = uracil
  modified_base 135: mod_base = OTHER; note = uracil
  modified_base 137: mod_base = OTHER; note = uracil
  modified_base 146: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 173: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 195: mod_base = OTHER; note = uracil
  modified_base 200: mod_base = OTHER; note = uracil
  modified_base 201: mod_base = OTHER; note = uracil
  modified_base 205: mod_base = OTHER; note = uracil
  modified_base 207: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 229: mod_base = OTHER; note = uracil
  modified_base 234: mod_base = OTHER; note = uracil
  modified_base 237: mod_base = OTHER; note = uracil
  modified_base 244: mod_base = OTHER; note = uracil
  modified_base 253: mod_base = OTHER; note = uracil
  modified_base 259: mod_base = OTHER; note = uracil
  modified_base 262: mod_base = OTHER; note = uracil
  modified_base 268: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 277: mod_base = OTHER; note = uracil
  modified_base 283: mod_base = OTHER; note = uracil
  modified_base 284: mod_base = OTHER; note = uracil
  modified_base 293: mod_base = OTHER; note = uracil
  modified_base 300: mod_base = OTHER; note = uracil
tatagatatattattatttgggaatttgatattggtagtataattttgtaattttttaagagggtttaatttttttaaatgtaagtattagggttygggattatttaaatagtttygttttttttttgtttttttttaggggttatagygtgyggaaaagtgttttagatygttgtygtttttttatttttgaatttttttagtttttttttttatagtgattagttgtagaatagttttgggtygggtgggtaygygttattgaggtaattaattttggygttayggagggttaaggat

SEQ ID NO: 3 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 23: mod_base = OTHER; note = uracil
  modified_base 28: mod_base = OTHER; note = uracil
  modified_base 38: mod_base = OTHER; note = uracil
  modified_base 40: mod_base = OTHER; note = uracil
  modified_base 42: mod_base = OTHER; note = uracil
  modified_base 47: mod_base = OTHER; note = uracil
  modified_base 48: mod_base = OTHER; note = uracil
  modified_base 54: mod_base = OTHER; note = uracil
  modified_base 61: mod_base = OTHER; note = uracil
  modified_base 62: mod_base = OTHER; note = uracil
  modified_base 66: mod_base = OTHER; note = uracil
  modified_base 73: mod_base = OTHER; note = uracil
  modified_base 76: mod_base = OTHER; note = uracil
  modified_base 81: mod_base = OTHER; note = uracil
  modified_base 85: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 97: mod_base = OTHER; note = uracil
  modified_base 98: mod_base = OTHER; note = uracil
  modified_base 107: mod_base = OTHER; note = uracil
  modified_base 111: mod_base = OTHER; note = uracil
  modified_base 114: mod_base = OTHER; note = uracil
  modified_base 123: mod_base = OTHER; note = uracil
  modified_base 127: mod_base = OTHER; note = uracil
  modified_base 136: mod_base = OTHER; note = uracil
  modified_base 146: mod_base = OTHER; note = uracil
  modified_base 153: mod_base = OTHER; note = uracil
  modified_base 154: mod_base = OTHER; note = uracil
  modified_base 161: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 252: mod_base = OTHER; note = uracil
  modified_base 255: mod_base = OTHER; note = uracil
  modified_base 265: mod_base = OTHER; note = uracil
  modified_base 268: mod_base = OTHER; note = uracil
  modified_base 271: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 295: mod_base = OTHER; note = uracil
gggtgattagtgttattaaaagtagagtttgagtttatttttataattatyggttgtgggttagatatttggttgttttgtaggtagattaggtttttyggtgagttatgttgtttaaaatgttgtttgggaaygtagagaaagtttaaaygttaagaygttgaggatagtttygtaggtggattgttatgttyggttyggtttttttttggtttttagagtggattttttttttttttatagaggggaggtatttgatggtggttttagtagataatttggagaagaattatttagggt

SEQ ID NO: 4 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 14: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 31: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 82: mod_base = OTHER; note = uracil
  modified_base 89: mod_base = OTHER; note = uracil
  modified_base 90: mod_base = OTHER; note = uracil
  modified_base 100: mod_base = OTHER; note = uracil
  modified_base 105: mod_base = OTHER; note = uracil
  modified_base 110: mod_base = OTHER; note = uracil
  modified_base 115: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 131: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 144: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 176: mod_base = OTHER; note = uracil
  modified_base 179: mod_base = OTHER; note = uracil
  modified_base 188: mod_base = OTHER; note = uracil
  modified_base 191: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 208: mod_base = OTHER; note = uracil
  modified_base 209: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 221: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 237: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 268: mod_base = OTHER; note = uracil
  modified_base 270: mod_base = OTHER; note = uracil
  modified_base 274: mod_base = OTHER; note = uracil
  modified_base 276: mod_base = OTHER; note = uracil
  modified_base 279: mod_base = OTHER; note = uracil
  modified_base 289: mod_base = OTHER; note = uracil
  modified_base 291: mod_base = OTHER; note = uracil
  modified_base 296: mod_base = OTHER; note = uracil
  modified_base 298: mod_base = OTHER; note = uracil
  modified_base 299: mod_base = OTHER; note = uracil
  modified_base 300: mod_base = OTHER; note = uracil
attttgagtggtttttttttaggttgtttgttgaagttattattagatgttttttttttgtggggaggagaagggtttattttggggattaaaaaggggtygagtygggtatggtagtttatttgyggggttgtttttagygttttggygtttagattttttttgygtttttagatagtattttaagtagtatgatttatygggaagtttggtttgtttgtaaagtagttaaatgtttggtttatagtygatggttatgagagtaaatttaagttttgtttttagtggtattggttattt

SEQ ID NO: 5 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 16: mod_base = OTHER; note = uracil
  modified_base 28: mod_base = OTHER; note = uracil
  modified_base 31: mod_base = OTHER; note = uracil
  modified_base 41: mod_base = OTHER; note = uracil
  modified_base 53: mod_base = OTHER; note = uracil
  modified_base 55: mod_base = OTHER; note = uracil
  modified_base 61: mod_base = OTHER; note = uracil
  modified_base 75: mod_base = OTHER; note = uracil
  modified_base 101: mod_base = OTHER; note = uracil
  modified_base 106: mod_base = OTHER; note = uracil
  modified_base 113: mod_base = OTHER; note = uracil
  modified_base 121: mod_base = OTHER; note = uracil
  modified_base 124: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 149: mod_base = OTHER; note = uracil
  modified_base 153: mod_base = OTHER; note = uracil
  modified_base 156: mod_base = OTHER; note = uracil
  modified_base 158: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 169: mod_base = OTHER; note = uracil
  modified_base 180: mod_base = OTHER; note = uracil
  modified_base 186: mod_base = OTHER; note = uracil
  modified_base 195: mod_base = OTHER; note = uracil
  modified_base 203: mod_base = OTHER; note = uracil
  modified_base 206: mod_base = OTHER; note = uracil
  modified_base 210: mod_base = OTHER; note = uracil
  modified_base 211: mod_base = OTHER; note = uracil
  modified_base 217: mod_base = OTHER; note = uracil
  modified_base 222: mod_base = OTHER; note = uracil
  modified_base 223: mod_base = OTHER; note = uracil
  modified_base 229: mod_base = OTHER; note = uracil
  modified_base 243: mod_base = OTHER; note = uracil
  modified_base 250: mod_base = OTHER; note = uracil
  modified_base 251: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 260: mod_base = OTHER; note = uracil
  modified_base 264: mod_base = OTHER; note = uracil
  modified_base 267: mod_base = OTHER; note = uracil
  modified_base 272: mod_base = OTHER; note = uracil
  modified_base 273: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 297: mod_base = OTHER; note = uracil
cagttggggaggggatagggtaggtggttgtagaagggggttgggttgaggttttaggtgtagaygaggaggggttgggyggagggggtgaggaggggagtygggttgggggtyggggygttgttggggtttttttttygtttygggatygttygtttttgtttagattygtyggtaaatagaygtygtgatgttaygggygtygttgatttgtggttgaattyggagttgtaaatgagatgtaaggtgttagtagttttyggtygtagggtttaygagttataygygttttttygtygg

SEQ ID NO: 6 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 22: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 38: mod_base = OTHER; note = uracil
  modified_base 45: mod_base = OTHER; note = uracil
  modified_base 48: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 62: mod_base = OTHER; note = uracil
  modified_base 64: mod_base = OTHER; note = uracil
  modified_base 70: mod_base = OTHER; note = uracil
  modified_base 73: mod_base = OTHER; note = uracil
  modified_base 75: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 93: mod_base = OTHER; note = uracil
  modified_base 101: mod_base = OTHER; note = uracil
  modified_base 102: mod_base = OTHER; note = uracil
  modified_base 108: mod_base = OTHER; note = uracil
  modified_base 111: mod_base = OTHER; note = uracil
  modified_base 119: mod_base = OTHER; note = uracil
  modified_base 126: mod_base = OTHER; note = uracil
  modified_base 135: mod_base = OTHER; note = uracil
  modified_base 140: mod_base = OTHER; note = uracil
  modified_base 154: mod_base = OTHER; note = uracil
  modified_base 155: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 298: mod_base = OTHER; note = uracil
tyggyggaggagygygtgtggttygtaggttttgyggtyggaggttgttggtattttgtattttatttatagtttygggtttagttataggttagyggygttygtgatattayggygtttgtttatygaygggtttgggtaagagyggayggtttyggggygggagggggattttagtagygtttyggtttttagttyggtttttttttttatttttttygtttagttttttttygtttgtatttgagattttaatttagtttttttttgtagttatttattttgttttttttttagttg

SEQ ID NO: 7 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 30: mod_base = OTHER; note = uracil
  modified_base 32: mod_base = OTHER; note = uracil
  modified_base 37: mod_base = OTHER; note = uracil
  modified_base 52: mod_base = OTHER; note = uracil
  modified_base 56: mod_base = OTHER; note = uracil
  modified_base 60: mod_base = OTHER; note = uracil
  modified_base 66: mod_base = OTHER; note = uracil
  modified_base 67: mod_base = OTHER; note = uracil
  modified_base 77: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 95: mod_base = OTHER; note = uracil
  modified_base 100: mod_base = OTHER; note = uracil
  modified_base 118: mod_base = OTHER; note = uracil
  modified_base 127: mod_base = OTHER; note = uracil
  modified_base 130: mod_base = OTHER; note = uracil
  modified_base 132: mod_base = OTHER; note = uracil
  modified_base 140: mod_base = OTHER; note = uracil
  modified_base 154: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 201: mod_base = OTHER; note = uracil
  modified_base 203: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 220: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 243: mod_base = OTHER; note = uracil
  modified_base 251: mod_base = OTHER; note = uracil
  modified_base 256: mod_base = OTHER; note = uracil
  modified_base 261: mod_base = OTHER; note = uracil
  modified_base 266: mod_base = OTHER; note = uracil
  modified_base 267: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 298: mod_base = OTHER; note = uracil
  modified_base 300: mod_base = OTHER; note = uracil
ttttttgtaaaatggggtygtttataaaatttataataaagtgttgaggtttygataagtygaaatttgtgaaaagtttgtgtaaattttagagttgtatatggatggttgaaggatttatttygatagtttyggggagtygtgggagggaagttgayggyggtttttgttgtttttttattttttagttttttygaagattttgagtagtttggagattaaaggtgattggggtttgttggtatggaggtygggttyggtagaatttgtttttyggttttttgtttattttttatttat

SEQ ID NO: 8 - DNA, 300 bp, synthetic construct
  misc_feature 1..300: note = Synthetic polynucleotide
  source 1..300: mol_type = other DNA
  modified_base 17: mod_base = OTHER; note = uracil
  modified_base 24: mod_base = OTHER; note = uracil
  modified_base 32: mod_base = OTHER; note = uracil
  modified_base 38: mod_base = OTHER; note = uracil
  modified_base 41: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 91: mod_base = OTHER; note = uracil
  modified_base 94: mod_base = OTHER; note = uracil
  modified_base 96: mod_base = OTHER; note = uracil
  modified_base 102: mod_base = OTHER; note = uracil
  modified_base 113: mod_base = OTHER; note = uracil
  modified_base 129: mod_base = OTHER; note = uracil
  modified_base 132: mod_base = OTHER; note = uracil
  modified_base 138: mod_base = OTHER; note = uracil
  modified_base 141: mod_base = OTHER; note = uracil
  modified_base 145: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 172: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 204: mod_base = OTHER; note = uracil
  modified_base 207: mod_base = OTHER; note = uracil
  modified_base 209: mod_base = OTHER; note = uracil
  modified_base 219: mod_base = OTHER; note = uracil
  modified_base 221: mod_base = OTHER; note = uracil
  modified_base 225: mod_base = OTHER; note = uracil
  modified_base 230: mod_base = OTHER; note = uracil
  modified_base 232: mod_base = OTHER; note = uracil
  modified_base 242: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 258: mod_base = OTHER; note = uracil
  modified_base 260: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 294: mod_base = OTHER; note = uracil
gtgggtgggaggtgggtagggggtygggaagtaggttttgtygagttyggtttttatgttagtaggttttaattatttttgatttttaggttgtttagagttttygggagggttgggaggtaggagaatagtaagagtygtygttagttttttttttayggtttttyggagttgtygaaatagattttttaattatttatgtatagttttgaggtttatataagttttttataggtttyggtttgtyggaattttaatattttgttatgagttttgtgggyggttttattttatagaaaa

SEQ ID NO: 9 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 13: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 30: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 69: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 86: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 97: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 112: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 131: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 145: mod_base = OTHER; note = uracil
  modified_base 148: mod_base = OTHER; note = uracil
  modified_base 150: mod_base = OTHER; note = uracil
  modified_base 155: mod_base = OTHER; note = uracil
  modified_base 163: mod_base = OTHER; note = uracil
  modified_base 169: mod_base = OTHER; note = uracil
  modified_base 171: mod_base = OTHER; note = uracil
  modified_base 177: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 189: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 212: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 234: mod_base = OTHER; note = uracil
  modified_base 237: mod_base = OTHER; note = uracil
  modified_base 247: mod_base = OTHER; note = uracil
  modified_base 249: mod_base = OTHER; note = uracil
  modified_base 255: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 275: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 296: mod_base = OTHER; note = uracil
  modified_base 297: mod_base = OTHER; note = uracil
  modified_base 298: mod_base = OTHER; note = uracil
  modified_base 299: mod_base = OTHER; note = uracil
tgagtagtgttttagygtttagagagatattgtggagaaggtttattaggatgtttatttgttttatataagagtttaattttggtatatttgtggtatatttgtggagagttgttttggtttyggttgtttggtaggtttgggttatttygagtaggggaattggggtatagtggttgtattttyggttatattttggtttttttagtttttgatgttygttttttaggtggtagtatgaggtgatttagggatagaygtttttatygtgaygtaagtttagtttttagtggagttttt

SEQ ID NO: 10 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 8: mod_base = OTHER; note = uracil
  modified_base 9: mod_base = OTHER; note = uracil
  modified_base 11: mod_base = OTHER; note = uracil
  modified_base 18: mod_base = OTHER; note = uracil
  modified_base 23: mod_base = OTHER; note = uracil
  modified_base 30: mod_base = OTHER; note = uracil
  modified_base 44: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 65: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 84: mod_base = OTHER; note = uracil
  modified_base 87: mod_base = OTHER; note = uracil
  modified_base 93: mod_base = OTHER; note = uracil
  modified_base 102: mod_base = OTHER; note = uracil
  modified_base 103: mod_base = OTHER; note = uracil
  modified_base 113: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 168: mod_base = OTHER; note = uracil
  modified_base 172: mod_base = OTHER; note = uracil
  modified_base 175: mod_base = OTHER; note = uracil
  modified_base 181: mod_base = OTHER; note = uracil
  modified_base 182: mod_base = OTHER; note = uracil
  modified_base 187: mod_base = OTHER; note = uracil
  modified_base 190: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 216: mod_base = OTHER; note = uracil
  modified_base 217: mod_base = OTHER; note = uracil
  modified_base 227: mod_base = OTHER; note = uracil
  modified_base 229: mod_base = OTHER; note = uracil
  modified_base 240: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 260: mod_base = OTHER; note = uracil
  modified_base 261: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 275: mod_base = OTHER; note = uracil
  modified_base 277: mod_base = OTHER; note = uracil
  modified_base 279: mod_base = OTHER; note = uracil
  modified_base 286: mod_base = OTHER; note = uracil
  modified_base 292: mod_base = OTHER; note = uracil
  modified_base 294: mod_base = OTHER; note = uracil
  modified_base 297: mod_base = OTHER; note = uracil
  modified_base 299: mod_base = OTHER; note = uracil
aggggttttattgggggttggatttgygttaygataagggygtttgtttttgagttattttatgttgttatttgaggggygggtattaggaattggaaaaattagggtatagtyggaggtgtagttattgtgttttagtttttttgttyggagtagtttaggtttgttagataatyggggttagaatagttttttataggtgtgttataggtgtgttaaagttaggtttttgtgtaaggtaggtaggtattttggtggattttttttatagtgtttttttgggygttgaaatattgttta

SEQ ID NO: 11 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 13: mod_base = OTHER; note = uracil
  modified_base 14: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 35: mod_base = OTHER; note = uracil
  modified_base 38: mod_base = OTHER; note = uracil
  modified_base 49: mod_base = OTHER; note = uracil
  modified_base 52: mod_base = OTHER; note = uracil
  modified_base 57: mod_base = OTHER; note = uracil
  modified_base 62: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 74: mod_base = OTHER; note = uracil
  modified_base 77: mod_base = OTHER; note = uracil
  modified_base 79: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 93: mod_base = OTHER; note = uracil
  modified_base 96: mod_base = OTHER; note = uracil
  modified_base 99: mod_base = OTHER; note = uracil
  modified_base 128: mod_base = OTHER; note = uracil
  modified_base 131: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 156: mod_base = OTHER; note = uracil
  modified_base 163: mod_base = OTHER; note = uracil
  modified_base 168: mod_base = OTHER; note = uracil
  modified_base 170: mod_base = OTHER; note = uracil
  modified_base 175: mod_base = OTHER; note = uracil
  modified_base 178: mod_base = OTHER; note = uracil
  modified_base 182: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 193: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 208: mod_base = OTHER; note = uracil
  modified_base 214: mod_base = OTHER; note = uracil
  modified_base 223: mod_base = OTHER; note = uracil
  modified_base 229: mod_base = OTHER; note = uracil
  modified_base 230: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 255: mod_base = OTHER; note = uracil
  modified_base 259: mod_base = OTHER; note = uracil
  modified_base 270: mod_base = OTHER; note = uracil
  modified_base 277: mod_base = OTHER; note = uracil
  modified_base 282: mod_base = OTHER; note = uracil
  modified_base 283: mod_base = OTHER; note = uracil
  modified_base 291: mod_base = OTHER; note = uracil
  modified_base 293: mod_base = OTHER; note = uracil
  modified_base 298: mod_base = OTHER; note = uracil
  modified_base 300: mod_base = OTHER; note = uracil
ttttgtaaaattttagagttaggtatatttaattttgtaaygtggtagttgtatgattgtataagttttttaatagtatygggttttagtgatattatttgttaaatgggttggtgatgataatggttagtatttatggaggagtttatayggtgttaagtgttttatatatattagttaattgaatttttattgttgttaatgagataggtattattgaattagaggttyggagagagttttaygyggttggttatattggtgaagagtttggtttaatgtttggtgaattttyggtat

SEQ ID NO: 12 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 34: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 82: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 97: mod_base = OTHER; note = uracil
  modified_base 103: mod_base = OTHER; note = uracil
  modified_base 106: mod_base = OTHER; note = uracil
  modified_base 117: mod_base = OTHER; note = uracil
  modified_base 124: mod_base = OTHER; note = uracil
  modified_base 139: mod_base = OTHER; note = uracil
  modified_base 141: mod_base = OTHER; note = uracil
  modified_base 146: mod_base = OTHER; note = uracil
  modified_base 148: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 182: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 200: mod_base = OTHER; note = uracil
  modified_base 210: mod_base = OTHER; note = uracil
  modified_base 212: mod_base = OTHER; note = uracil
  modified_base 218: mod_base = OTHER; note = uracil
  modified_base 219: mod_base = OTHER; note = uracil
  modified_base 225: mod_base = OTHER; note = uracil
  modified_base 236: mod_base = OTHER; note = uracil
  modified_base 242: mod_base = OTHER; note = uracil
  modified_base 246: mod_base = OTHER; note = uracil
  modified_base 250: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 264: mod_base = OTHER; note = uracil
  modified_base 278: mod_base = OTHER; note = uracil
  modified_base 279: mod_base = OTHER; note = uracil
  modified_base 283: mod_base = OTHER; note = uracil
  modified_base 285: mod_base = OTHER; note = uracil
  modified_base 296: mod_base = OTHER; note = uracil
gtgtygagagtttattaggtattgaattaagttttttattagtatgattaatygygtggagtttttttygggtttttgatttaatagtatttgttttattggtagtagtgaggatttagttagttgatatgtgtaaagtatttagtatygtgtgggtttttttataaatgttgattattattattattaatttatttaatagatgatgttattgaggttyggtgttgttaagggatttgtatagttatgtagttattaygttgtagaattgggtatatttggttttggaattttataaga

SEQ ID NO: 13 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 9: mod_base = OTHER; note = uracil
  modified_base 16: mod_base = OTHER; note = uracil
  modified_base 24: mod_base = OTHER; note = uracil
  modified_base 30: mod_base = OTHER; note = uracil
  modified_base 31: mod_base = OTHER; note = uracil
  modified_base 38: mod_base = OTHER; note = uracil
  modified_base 41: mod_base = OTHER; note = uracil
  modified_base 43: mod_base = OTHER; note = uracil
  modified_base 46: mod_base = OTHER; note = uracil
  modified_base 54: mod_base = OTHER; note = uracil
  modified_base 59: mod_base = OTHER; note = uracil
  modified_base 62: mod_base = OTHER; note = uracil
  modified_base 66: mod_base = OTHER; note = uracil
  modified_base 67: mod_base = OTHER; note = uracil
  modified_base 70: mod_base = OTHER; note = uracil
  modified_base 71: mod_base = OTHER; note = uracil
  modified_base 77: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 122: mod_base = OTHER; note = uracil
  modified_base 130: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 180: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 231: mod_base = OTHER; note = uracil
  modified_base 238: mod_base = OTHER; note = uracil
  modified_base 240: mod_base = OTHER; note = uracil
  modified_base 246: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 280: mod_base = OTHER; note = uracil
  modified_base 295: mod_base = OTHER; note = uracil
  modified_base 298: mod_base = OTHER; note = uracil
ttyggagttagtgaatttgtgattyggagttagttaattttatagttaatgtgttgagtagtattttagttagygtttgaagttagagtagggaggyggaygggttttaggagttygaggttygggaagtygaagtattattaaattgagygaggttttaatttttttttttaggaggttyggttgttttttattagtagtttaattatagggttttgttttagaygttattatttttttttttttagtgtgtttagtagtaatttygattgttaataataaygtgaaaaataattgtag

SEQ ID NO: 14 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 15: mod_base = OTHER; note = uracil
  modified_base 29: mod_base = OTHER; note = uracil
  modified_base 41: mod_base = OTHER; note = uracil
  modified_base 44: mod_base = OTHER; note = uracil
  modified_base 49: mod_base = OTHER; note = uracil
  modified_base 51: mod_base = OTHER; note = uracil
  modified_base 53: mod_base = OTHER; note = uracil
  modified_base 77: mod_base = OTHER; note = uracil
  modified_base 83: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 101: mod_base = OTHER; note = uracil
  modified_base 104: mod_base = OTHER; note = uracil
  modified_base 115: mod_base = OTHER; note = uracil
  modified_base 118: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 153: mod_base = OTHER; note = uracil
  modified_base 166: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 215: mod_base = OTHER; note = uracil
  modified_base 219: mod_base = OTHER; note = uracil
  modified_base 222: mod_base = OTHER; note = uracil
  modified_base 228: mod_base = OTHER; note = uracil
  modified_base 232: mod_base = OTHER; note = uracil
  modified_base 240: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 250: mod_base = OTHER; note = uracil
  modified_base 256: mod_base = OTHER; note = uracil
  modified_base 268: mod_base = OTHER; note = uracil
  modified_base 272: mod_base = OTHER; note = uracil
  modified_base 274: mod_base = OTHER; note = uracil
  modified_base 280: mod_base = OTHER; note = uracil
  modified_base 282: mod_base = OTHER; note = uracil
  modified_base 288: mod_base = OTHER; note = uracil
  modified_base 290: mod_base = OTHER; note = uracil
  modified_base 294: mod_base = OTHER; note = uracil
  modified_base 296: mod_base = OTHER; note = uracil
ttgtagttattttttaygttgttgttggtagtygaggttgttgttggatatattgaaaaagagaaaatagtaaygtttggagtaggattttgtggttgggttgttggtgggaggtagtyggattttttgggagggagagttggaatttygtttagtttggtggtgtttyggtttttyggatttygaatttttggggttygttygtttttttgttttggttttagaygttggttggaatgttgtttagtatattagttgtgaagttaattggtttyggattataagtttattggtttygga

SEQ ID NO: 15 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 10: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 50: mod_base = OTHER; note = uracil
  modified_base 51: mod_base = OTHER; note = uracil
  modified_base 63: mod_base = OTHER; note = uracil
  modified_base 65: mod_base = OTHER; note = uracil
  modified_base 69: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 84: mod_base = OTHER; note = uracil
  modified_base 94: mod_base = OTHER; note = uracil
  modified_base 100: mod_base = OTHER; note = uracil
  modified_base 109: mod_base = OTHER; note = uracil
  modified_base 111: mod_base = OTHER; note = uracil
  modified_base 119: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 166: mod_base = OTHER; note = uracil
  modified_base 175: mod_base = OTHER; note = uracil
  modified_base 185: mod_base = OTHER; note = uracil
  modified_base 198: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 220: mod_base = OTHER; note = uracil
  modified_base 229: mod_base = OTHER; note = uracil
  modified_base 235: mod_base = OTHER; note = uracil
  modified_base 239: mod_base = OTHER; note = uracil
  modified_base 246: mod_base = OTHER; note = uracil
  modified_base 252: mod_base = OTHER; note = uracil
  modified_base 253: mod_base = OTHER; note = uracil
  modified_base 268: mod_base = OTHER; note = uracil
  modified_base 270: mod_base = OTHER; note = uracil
  modified_base 277: mod_base = OTHER; note = uracil
  modified_base 278: mod_base = OTHER; note = uracil
  modified_base 288: mod_base = OTHER; note = uracil
  modified_base 289: mod_base = OTHER; note = uracil
  modified_base 291: mod_base = OTHER; note = uracil
  modified_base 294: mod_base = OTHER; note = uracil
  modified_base 296: mod_base = OTHER; note = uracil
  modified_base 298: mod_base = OTHER; note = uracil
  modified_base 299: mod_base = OTHER; note = uracil
ttgttaaaattggaagtaattaagatgttttttaaaaggtgaatggaggttaggtgyggtggtttaygtygataattttagtattttgggaggttgaggtaggtggattatttgagattaygagtttgagattagttyggttaatatggygaaatttygtttttattaaaaatattaagattaatygggygtggtggtaygtgtttgttattttagttatttgggaagttgaggtaggtaaattgtttgaatttgggaggtggaggttatagtgagttaagattgtgttattgtatttta

SEQ ID NO: 16 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 14: mod_base = OTHER; note = uracil
  modified_base 16: mod_base = OTHER; note = uracil
  modified_base 20: mod_base = OTHER; note = uracil
  modified_base 25: mod_base = OTHER; note = uracil
  modified_base 27: mod_base = OTHER; note = uracil
  modified_base 29: mod_base = OTHER; note = uracil
  modified_base 35: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 52: mod_base = OTHER; note = uracil
  modified_base 56: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 85: mod_base = OTHER; note = uracil
  modified_base 94: mod_base = OTHER; note = uracil
  modified_base 98: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 122: mod_base = OTHER; note = uracil
  modified_base 152: mod_base = OTHER; note = uracil
  modified_base 153: mod_base = OTHER; note = uracil
  modified_base 161: mod_base = OTHER; note = uracil
  modified_base 166: mod_base = OTHER; note = uracil
  modified_base 171: mod_base = OTHER; note = uracil
  modified_base 173: mod_base = OTHER; note = uracil
  modified_base 177: mod_base = OTHER; note = uracil
  modified_base 185: mod_base = OTHER; note = uracil
  modified_base 187: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 220: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 274: mod_base = OTHER; note = uracil
  modified_base 277: mod_base = OTHER; note = uracil
  modified_base 285: mod_base = OTHER; note = uracil
  modified_base 288: mod_base = OTHER; note = uracil
  modified_base 289: mod_base = OTHER; note = uracil
  modified_base 298: mod_base = OTHER; note = uracil
tggagtgtagtggtataattttggtttattgtgatttttattttttaggtttaagtaatttgtttgttttagttttttaagtagttgggataataggtaygtgttattaygttyggttaattttagtatttttagtagagayggggtttygttatgttggtygggttggttttaaattygtgattttaagtgatttatttgttttagttttttaaagtgttgggattatyggygtgagttatygtatttggtttttatttattttttgaggggtattttggttgtttttagttttggtaa

SEQ ID NO: 17 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 14: mod_base = OTHER; note = uracil
  modified_base 20: mod_base = OTHER; note = uracil
  modified_base 26: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 61: mod_base = OTHER; note = uracil
  modified_base 65: mod_base = OTHER; note = uracil
  modified_base 68: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 100: mod_base = OTHER; note = uracil
  modified_base 103: mod_base = OTHER; note = uracil
  modified_base 107: mod_base = OTHER; note = uracil
  modified_base 109: mod_base = OTHER; note = uracil
  modified_base 116: mod_base = OTHER; note = uracil
  modified_base 122: mod_base = OTHER; note = uracil
  modified_base 128: mod_base = OTHER; note = uracil
  modified_base 130: mod_base = OTHER; note = uracil
  modified_base 131: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 151: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 162: mod_base = OTHER; note = uracil
  modified_base 163: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 184: mod_base = OTHER; note = uracil
  modified_base 187: mod_base = OTHER; note = uracil
  modified_base 189: mod_base = OTHER; note = uracil
  modified_base 195: mod_base = OTHER; note = uracil
  modified_base 196: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 214: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 230: mod_base = OTHER; note = uracil
  modified_base 231: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 289: mod_base = OTHER; note = uracil
  modified_base 295: mod_base = OTHER; note = uracil
  modified_base 298: mod_base = OTHER; note = uracil
ggygggattygagtygagataygtgttggagyggagtygtttttttayggtygttagtygtagataattgattttttyggtatygygttygyggttttgttgttggtttyggtgtttygggtyggaatttttgtggttttagygttygygtyggttattggttagygtttgggtttygttttgtagtttyggggttatagggtatagttttagttttgattttttygttttygaaaggaygtttaaggygattttttattttattttttttaattttttttttatgttttgyggtaattt

SEQ ID NO: 18 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 14: mod_base = OTHER; note = uracil
  modified_base 52: mod_base = OTHER; note = uracil
  modified_base 53: mod_base = OTHER; note = uracil
  modified_base 62: mod_base = OTHER; note = uracil
  modified_base 63: mod_base = OTHER; note = uracil
  modified_base 82: mod_base = OTHER; note = uracil
  modified_base 87: mod_base = OTHER; note = uracil
  modified_base 93: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 114: mod_base = OTHER; note = uracil
  modified_base 117: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 146: mod_base = OTHER; note = uracil
  modified_base 158: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 186: mod_base = OTHER; note = uracil
  modified_base 188: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 201: mod_base = OTHER; note = uracil
  modified_base 206: mod_base = OTHER; note = uracil
  modified_base 220: mod_base = OTHER; note = uracil
  modified_base 230: mod_base = OTHER; note = uracil
  modified_base 237: mod_base = OTHER; note = uracil
  modified_base 243: mod_base = OTHER; note = uracil
  modified_base 250: mod_base = OTHER; note = uracil
  modified_base 264: mod_base = OTHER; note = uracil
  modified_base 266: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 282: mod_base = OTHER; note = uracil
  modified_base 287: mod_base = OTHER; note = uracil
  modified_base 294: mod_base = OTHER; note = uracil
  modified_base 295: mod_base = OTHER; note = uracil
  modified_base 298: mod_base = OTHER; note = uracil
  modified_base 299: mod_base = OTHER; note = uracil
  modified_base 300: mod_base = OTHER; note = uracil
agttgtygtaggatatgggggagaagttggggaggatggggtgggaggtygttttgggygttttttygggaayggggaggttaaagttaaagttgtgttttatggtttyggagttgtagggygaggtttaagygttggttagtggtyggygygaaygttggagttataggagtttyggttygagatatyggagttagtagtagggtygygaaygygatgtyggggaggttagttgtttgyggttggygatygtgaggaagyggtttygttttagtaygtgtttyggttyggatttygttt

SEQ ID NO: 19 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 5: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 21: mod_base = OTHER; note = uracil
  modified_base 27: mod_base = OTHER; note = uracil
  modified_base 31: mod_base = OTHER; note = uracil
  modified_base 35: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 54: mod_base = OTHER; note = uracil
  modified_base 63: mod_base = OTHER; note = uracil
  modified_base 64: mod_base = OTHER; note = uracil
  modified_base 69: mod_base = OTHER; note = uracil
  modified_base 70: mod_base = OTHER; note = uracil
  modified_base 79: mod_base = OTHER; note = uracil
  modified_base 86: mod_base = OTHER; note = uracil
  modified_base 94: mod_base = OTHER; note = uracil
  modified_base 111: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 125: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 143: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 164: mod_base = OTHER; note = uracil
  modified_base 186: mod_base = OTHER; note = uracil
  modified_base 205: mod_base = OTHER; note = uracil
  modified_base 210: mod_base = OTHER; note = uracil
  modified_base 212: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 247: mod_base = OTHER; note = uracil
  modified_base 248: mod_base = OTHER; note = uracil
  modified_base 256: mod_base = OTHER; note = uracil
  modified_base 260: mod_base = OTHER; note = uracil
  modified_base 271: mod_base = OTHER; note = uracil
  modified_base 272: mod_base = OTHER; note = uracil
  modified_base 276: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 289: mod_base = OTHER; note = uracil
  modified_base 295: mod_base = OTHER; note = uracil
  modified_base 298: mod_base = OTHER; note = uracil
ttagtagggaaggtagttaatagatgtagattygttttgtttatttgtggaggtyggtgaggttagggtttgttgggatttgaaatagtgaggtaagtgggtgtgtggtgttgggtttttygtttaagtttttttagygtgttagttttyggagttttatgtgtagggtgttggggaagggygggttgaatygtgggtgggagttttggtttaaagttttaggtgagtggaggaattgggggyggatttgaagtattgttttgaagtggatttggtaggttttttgggtttgtgtagttg

SEQ ID NO: 20 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 7: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 38: mod_base = OTHER; note = uracil
  modified_base 43: mod_base = OTHER; note = uracil
  modified_base 48: mod_base = OTHER; note = uracil
  modified_base 51: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 85: mod_base = OTHER; note = uracil
  modified_base 92: mod_base = OTHER; note = uracil
  modified_base 93: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 140: mod_base = OTHER; note = uracil
  modified_base 147: mod_base = OTHER; note = uracil
  modified_base 149: mod_base = OTHER; note = uracil
  modified_base 156: mod_base = OTHER; note = uracil
  modified_base 160: mod_base = OTHER; note = uracil
  modified_base 164: mod_base = OTHER; note = uracil
  modified_base 173: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 219: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 262: mod_base = OTHER; note = uracil
  modified_base 272: mod_base = OTHER; note = uracil
  modified_base 275: mod_base = OTHER; note = uracil
  modified_base 278: mod_base = OTHER; note = uracil
  modified_base 285: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 297: mod_base = OTHER; note = uracil
tagttgtataagtttaagaggtttgttaggtttattttaagatagtattttaggttygtttttaatttttttatttatttggggttttgagttaagatttttatttaygatttagttygtttttttttaatattttgtatataaggtttygggaattggtaygttgggagaatttgagyggggagtttagtattatatatttatttgttttattgttttaagttttaataggttttggttttatyggtttttataggtaggtagagygagtttgtatttgttggttgttttttttgttgg

SEQ ID NO: 21 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 6: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 25: mod_base = OTHER; note = uracil
  modified_base 26: mod_base = OTHER; note = uracil
  modified_base 32: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 47: mod_base = OTHER; note = uracil
  modified_base 49: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 58: mod_base = OTHER; note = uracil
  modified_base 59: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 99: mod_base = OTHER; note = uracil
  modified_base 102: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 124: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 158: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 192: mod_base = OTHER; note = uracil
  modified_base 197: mod_base = OTHER; note = uracil
  modified_base 199: mod_base = OTHER; note = uracil
  modified_base 202: mod_base = OTHER; note = uracil
  modified_base 208: mod_base = OTHER; note = uracil
  modified_base 210: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 222: mod_base = OTHER; note = uracil
  modified_base 223: mod_base = OTHER; note = uracil
  modified_base 228: mod_base = OTHER; note = uracil
  modified_base 230: mod_base = OTHER; note = uracil
  modified_base 235: mod_base = OTHER; note = uracil
  modified_base 240: mod_base = OTHER; note = uracil
  modified_base 254: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 261: mod_base = OTHER; note = uracil
  modified_base 263: mod_base = OTHER; note = uracil
  modified_base 273: mod_base = OTHER; note = uracil
  modified_base 274: mod_base = OTHER; note = uracil
  modified_base 278: mod_base = OTHER; note = uracil
  modified_base 280: mod_base = OTHER; note = uracil
  modified_base 281: mod_base = OTHER; note = uracil
  modified_base 286: mod_base = OTHER; note = uracil
  modified_base 287: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ttagattygttttttttattygggtttyggatttttattttagttttttttttttggttagtgattatttatttttaattttatttygtttygtygygtaattattttttttttttattyggattgggattattatttttattttatttygtttagtttgggattttatttgttttttttttaattttatattaatttttgtttggtttttttttttttggtttaatttttygtttyggtttattggggayggttatttttatagtttggttttaaatattagtttttggatggattttt

SEQ ID NO: 22 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 11: mod_base = OTHER; note = uracil
  modified_base 12: mod_base = OTHER; note = uracil
  modified_base 18: mod_base = OTHER; note = uracil
  modified_base 31: mod_base = OTHER; note = uracil
  modified_base 32: mod_base = OTHER; note = uracil
  modified_base 36: mod_base = OTHER; note = uracil
  modified_base 48: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 62: mod_base = OTHER; note = uracil
  modified_base 80: mod_base = OTHER; note = uracil
  modified_base 81: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 129: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 145: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 179: mod_base = OTHER; note = uracil
  modified_base 238: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 258: mod_base = OTHER; note = uracil
  modified_base 271: mod_base = OTHER; note = uracil
  modified_base 277: mod_base = OTHER; note = uracil
  modified_base 278: mod_base = OTHER; note = uracil
  modified_base 297: mod_base = OTHER; note = uracil
gggaatttatttaggaattggtgtttggaattaaattgtgagagtggtygtttttaataagtygagaygagagattaggttaaagaggaagagattaagtagagattagtgtgggattggggaggaggtaggtggagttttagattgggyggagtggagtggggatgatggttttagttygggtgaagggaggaggtagttgygyggyggggyggggtgggattgggggtgggtaattattggttaggagagagaagttggggtgaaagttygaggttygggtggggagggygagtttgg

SEQ ID NO: 23 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 29: mod_base = OTHER; note = uracil
  modified_base 30: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 42: mod_base = OTHER; note = uracil
  modified_base 50: mod_base = OTHER; note = uracil
  modified_base 51: mod_base = OTHER; note = uracil
  modified_base 54: mod_base = OTHER; note = uracil
  modified_base 64: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 85: mod_base = OTHER; note = uracil
  modified_base 88: mod_base = OTHER; note = uracil
  modified_base 99: mod_base = OTHER; note = uracil
  modified_base 105: mod_base = OTHER; note = uracil
  modified_base 109: mod_base = OTHER; note = uracil
  modified_base 111: mod_base = OTHER; note = uracil
  modified_base 125: mod_base = OTHER; note = uracil
  modified_base 130: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 146: mod_base = OTHER; note = uracil
  modified_base 147: mod_base = OTHER; note = uracil
  modified_base 150: mod_base = OTHER; note = uracil
  modified_base 153: mod_base = OTHER; note = uracil
  modified_base 154: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 183: mod_base = OTHER; note = uracil
  modified_base 195: mod_base = OTHER; note = uracil
  modified_base 196: mod_base = OTHER; note = uracil
  modified_base 226: mod_base = OTHER; note = uracil
  modified_base 227: mod_base = OTHER; note = uracil
  modified_base 233: mod_base = OTHER; note = uracil
  modified_base 244: mod_base = OTHER; note = uracil
  modified_base 253: mod_base = OTHER; note = uracil
  modified_base 259: mod_base = OTHER; note = uracil
  modified_base 268: mod_base = OTHER; note = uracil
  modified_base 274: mod_base = OTHER; note = uracil
  modified_base 297: mod_base = OTHER; note = uracil
ygtaggttygygtttygttttygtttygtttgtygygtttttyggggygttygtattaaagygtatatgtaagttatgaattattaattgaaaggagttaattatyggttttaaaaaygagtgtttgygttygtagygtttygggttattygtttatttayggagygatttatttygttyggttggggagggggtttygggagggagagagayggagaaayggagttygagatygggagagagtyggagaggtagggattggagagtttgggataygaaggagaggyggggagagatyga

SEQ ID NO: 24 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 8: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 70: mod_base = OTHER; note = uracil
  modified_base 76: mod_base = OTHER; note = uracil
  modified_base 78: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 92: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 136: mod_base = OTHER; note = uracil
  modified_base 138: mod_base = OTHER; note = uracil
  modified_base 156: mod_base = OTHER; note = uracil
  modified_base 157: mod_base = OTHER; note = uracil
  modified_base 165: mod_base = OTHER; note = uracil
  modified_base 174: mod_base = OTHER; note = uracil
  modified_base 178: mod_base = OTHER; note = uracil
  modified_base 180: mod_base = OTHER; note = uracil
  modified_base 193: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 223: mod_base = OTHER; note = uracil
  modified_base 228: mod_base = OTHER; note = uracil
  modified_base 232: mod_base = OTHER; note = uracil
  modified_base 240: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 269: mod_base = OTHER; note = uracil
  modified_base 295: mod_base = OTHER; note = uracil
  modified_base 296: mod_base = OTHER; note = uracil
tyggttttttttygtttttttttygtgttttagattttttagtttttgttttttyggttttttttyggtttygggtttygttttttygtttttttttttttygaggttttttttttagtygggyggggtagatygtttygtaaataggyggatggttyggggygttgygagygtagatattygtttttagagtyggtaattgattttttttagttgataatttatggtttgtatatgygttttaatgygggygtttygggaggygyggtaggyggggygggagyggggygygggtttgyg

SEQ ID NO: 25 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 11: mod_base = OTHER; note = uracil
  modified_base 26: mod_base = OTHER; note = uracil
  modified_base 35: mod_base = OTHER; note = uracil
  modified_base 36: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 70: mod_base = OTHER; note = uracil
  modified_base 71: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 90: mod_base = OTHER; note = uracil
  modified_base 101: mod_base = OTHER; note = uracil
  modified_base 108: mod_base = OTHER; note = uracil
  modified_base 109: mod_base = OTHER; note = uracil
  modified_base 115: mod_base = OTHER; note = uracil
  modified_base 123: mod_base = OTHER; note = uracil
  modified_base 127: mod_base = OTHER; note = uracil
  modified_base 131: mod_base = OTHER; note = uracil
  modified_base 136: mod_base = OTHER; note = uracil
  modified_base 142: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 182: mod_base = OTHER; note = uracil
  modified_base 186: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 206: mod_base = OTHER; note = uracil
  modified_base 220: mod_base = OTHER; note = uracil
  modified_base 221: mod_base = OTHER; note = uracil
  modified_base 227: mod_base = OTHER; note = uracil
  modified_base 240: mod_base = OTHER; note = uracil
  modified_base 251: mod_base = OTHER; note = uracil
  modified_base 254: mod_base = OTHER; note = uracil
  modified_base 264: mod_base = OTHER; note = uracil
  modified_base 275: mod_base = OTHER; note = uracil
  modified_base 280: mod_base = OTHER; note = uracil
  modified_base 289: mod_base = OTHER; note = uracil
  modified_base 295: mod_base = OTHER; note = uracil
atagtygttgtagggaggaygygggtygtgagaattyggggatagtttttttttttgyggttttgtagtttyggatttattgggyggattagaaagtttgtagggagttagggattaggagatagatagatagygtagggatagagaaagyggagggatgttagaaagatygagtyggggatagatagagagatttagggtgagatagaggaagagatattyggggttgaaaayggtggtagaaagtgagtaatttagggagatagaaagagygtagaattygaaatttygaggtagaga

SEQ ID NO: 26 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 24: mod_base = OTHER; note = uracil
  modified_base 29: mod_base = OTHER; note = uracil
  modified_base 31: mod_base = OTHER; note = uracil
  modified_base 35: mod_base = OTHER; note = uracil
  modified_base 39: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 51: mod_base = OTHER; note = uracil
  modified_base 53: mod_base = OTHER; note = uracil
  modified_base 55: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 97: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 127: mod_base = OTHER; note = uracil
  modified_base 133: mod_base = OTHER; note = uracil
  modified_base 137: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 151: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 168: mod_base = OTHER; note = uracil
  modified_base 172: mod_base = OTHER; note = uracil
  modified_base 176: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 205: mod_base = OTHER; note = uracil
  modified_base 209: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 227: mod_base = OTHER; note = uracil
  modified_base 233: mod_base = OTHER; note = uracil
  modified_base 236: mod_base = OTHER; note = uracil
  modified_base 241: mod_base = OTHER; note = uracil
  modified_base 244: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 269: mod_base = OTHER; note = uracil
  modified_base 271: mod_base = OTHER; note = uracil
  modified_base 276: mod_base = OTHER; note = uracil
  modified_base 277: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 297: mod_base = OTHER; note = uracil
tttttgtttyggaatttygagttttgygttttttttgtttttttaagttgtttattttttgttatygtttttagtttygggtatttttttttttgttttattttgggtttttttgtttgttttygattyggtttttttggtattttttygttttttttgtttttgygttgtttgtttgttttttagtttttggttttttgtaaattttttgattygtttagtgggttygggattgtaggatygtaagaggggaggttgttttygggtttttayggttygygttttttttgtagygattgt

SEQ ID NO: 27 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 6: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 19: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 49: mod_base = OTHER; note = uracil
  modified_base 55: mod_base = OTHER; note = uracil
  modified_base 59: mod_base = OTHER; note = uracil
  modified_base 63: mod_base = OTHER; note = uracil
  modified_base 67: mod_base = OTHER; note = uracil
  modified_base 73: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 96: mod_base = OTHER; note = uracil
  modified_base 107: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 129: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 152: mod_base = OTHER; note = uracil
  modified_base 155: mod_base = OTHER; note = uracil
  modified_base 161: mod_base = OTHER; note = uracil
  modified_base 165: mod_base = OTHER; note = uracil
  modified_base 167: mod_base = OTHER; note = uracil
  modified_base 177: mod_base = OTHER; note = uracil
  modified_base 178: mod_base = OTHER; note = uracil
  modified_base 187: mod_base = OTHER; note = uracil
  modified_base 192: mod_base = OTHER; note = uracil
  modified_base 194: mod_base = OTHER; note = uracil
  modified_base 200: mod_base = OTHER; note = uracil
  modified_base 201: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 219: mod_base = OTHER; note = uracil
  modified_base 223: mod_base = OTHER; note = uracil
  modified_base 225: mod_base = OTHER; note = uracil
  modified_base 243: mod_base = OTHER; note = uracil
  modified_base 255: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 283: mod_base = OTHER; note = uracil
  modified_base 284: mod_base = OTHER; note = uracil
  modified_base 289: mod_base = OTHER; note = uracil
  modified_base 290: mod_base = OTHER; note = uracil
  modified_base 295: mod_base = OTHER; note = uracil
ttagtttgtatttyggygttggtttttagatagttaggtgttgtttygtayggttttgtttgtaggttggggtatgaagtattttggtatttaygttgggattggttttttattagggttggggygggttgtggttatttggttyggygygtygtagaggttggtttyggagaagatttgggggygtaagatttagaggttagagggtgtagtygttgttgatttatttgyggayggggyggttgggaggagygttagtttttgttgtgagygatttgagagttagggttaaatttgggt

SEQ ID NO: 28 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 19: mod_base = OTHER; note = uracil
  modified_base 21: mod_base = OTHER; note = uracil
  modified_base 23: mod_base = OTHER; note = uracil
  modified_base 30: mod_base = OTHER; note = uracil
  modified_base 32: mod_base = OTHER; note = uracil
  modified_base 34: mod_base = OTHER; note = uracil
  modified_base 37: mod_base = OTHER; note = uracil
  modified_base 43: mod_base = OTHER; note = uracil
  modified_base 49: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 68: mod_base = OTHER; note = uracil
  modified_base 71: mod_base = OTHER; note = uracil
  modified_base 80: mod_base = OTHER; note = uracil
  modified_base 83: mod_base = OTHER; note = uracil
  modified_base 89: mod_base = OTHER; note = uracil
  modified_base 92: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 111: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 126: mod_base = OTHER; note = uracil
  modified_base 129: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 214: mod_base = OTHER; note = uracil
  modified_base 215: mod_base = OTHER; note = uracil
  modified_base 222: mod_base = OTHER; note = uracil
  modified_base 225: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 243: mod_base = OTHER; note = uracil
  modified_base 248: mod_base = OTHER; note = uracil
  modified_base 258: mod_base = OTHER; note = uracil
  modified_base 261: mod_base = OTHER; note = uracil
  modified_base 263: mod_base = OTHER; note = uracil
  modified_base 264: mod_base = OTHER; note = uracil
  modified_base 268: mod_base = OTHER; note = uracil
  modified_base 272: mod_base = OTHER; note = uracil
  modified_base 279: mod_base = OTHER; note = uracil
  modified_base 280: mod_base = OTHER; note = uracil
  modified_base 285: mod_base = OTHER; note = uracil
  modified_base 293: mod_base = OTHER; note = uracil
  modified_base 297: mod_base = OTHER; note = uracil
atttagatttggttttggtttttaaatygtttataataggggttagygttttttttagtygtttygttygtaaatgagttagtagyggttgtattttttggtttttgagttttgygtttttaggtttttttyggagttagtttttgyggygygtygggttaggtgattatagttygttttaattttagtgagagattaattttagygtaaatattagggtgttttatgttttagtttgtaagtaagatygtgygaggtagtatttggttgtttggaggttagygtyggggtataggttga

SEQ ID NO: 29 - DNA, 301 bp, synthetic construct
  misc_feature 1..301: note = Synthetic polynucleotide
  source 1..301: mol_type = other DNA
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 39: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 54: mod_base = OTHER; note = uracil
  modified_base 57: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 72: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 85: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 184: mod_base = OTHER; note = uracil
  modified_base 189: mod_base = OTHER; note = uracil
  modified_base 191: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 225: mod_base = OTHER; note = uracil
  modified_base 228: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 277: mod_base = OTHER; note = uracil
  modified_base 280: mod_base = OTHER; note = uracil
  modified_base 291: mod_base = OTHER; note = uracil
  modified_base 295: mod_base = OTHER; note = uracil
  modified_base 296: mod_base = OTHER; note = uracil
  modified_base 297: mod_base = OTHER; note = uracil
gtttagttttataaaggtgagtggggtatttttagttgtygagtttttttagttagtagttttatattttatatttttttgtggtygtattttatagtttygtttyggtttataggtatttttaagaagaagtgtttgtttattattagygagaagagtagttttttgyggttttttttggagtaatgtatagggttttttyggggttttttygttagtgagggtagtyggggaggttttttttttygtttatygtttyggtagagtttttaggagtagttgaayggggttatgtttatyg

SEQ ID NO: 30 - DNA, 301 bp, synthetic construct
  misc_feature 1..301: note = Synthetic polynucleotide
  source 1..301: mol_type = other DNA
  modified_base 8: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 20: mod_base = OTHER; note = uracil
  modified_base 23: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 36: mod_base = OTHER; note = uracil
  modified_base 38: mod_base = OTHER; note = uracil
  modified_base 41: mod_base = OTHER; note = uracil
  modified_base 66: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 84: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 114: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 131: mod_base = OTHER; note = uracil
  modified_base 134: mod_base = OTHER; note = uracil
  modified_base 141: mod_base = OTHER; note = uracil
  modified_base 144: mod_base = OTHER; note = uracil
  modified_base 146: mod_base = OTHER; note = uracil
  modified_base 149: mod_base = OTHER; note = uracil
  modified_base 153: mod_base = OTHER; note = uracil
  modified_base 164: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 176: mod_base = OTHER; note = uracil
  modified_base 186: mod_base = OTHER; note = uracil
  modified_base 187: mod_base = OTHER; note = uracil
  modified_base 194: mod_base = OTHER; note = uracil
  modified_base 205: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 243: mod_base = OTHER; note = uracil
  modified_base 246: mod_base = OTHER; note = uracil
  modified_base 250: mod_base = OTHER; note = uracil
  modified_base 259: mod_base = OTHER; note = uracil
  modified_base 264: mod_base = OTHER; note = uracil
  modified_base 267: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 296: mod_base = OTHER; note = uracil
  modified_base 301: mod_base = OTHER; note = uracil
ygatgggtatgatttygtttagttgtttttggaggttttgtyggggyggtgggyggggaggggggttttttyggttgtttttattagyggaggagtttygggaagattttgtgtattgttttagggggagtygtaggaggttgtttttttygttgatggtgggtagatatttttttttaaggatgtttgtgggtyggggyggggttgtgaggtgyggttataggagaatgtgaggtatgaggttgttgattaggggagttyggtagttgggggtgttttatttatttttgtgaggttgggt

SEQ ID NO: 31 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 14: mod_base = OTHER; note = uracil
  modified_base 15: mod_base = OTHER; note = uracil
  modified_base 30: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 45: mod_base = OTHER; note = uracil
  modified_base 51: mod_base = OTHER; note = uracil
  modified_base 52: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 89: mod_base = OTHER; note = uracil
  modified_base 93: mod_base = OTHER; note = uracil
  modified_base 99: mod_base = OTHER; note = uracil
  modified_base 100: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 118: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 137: mod_base = OTHER; note = uracil
  modified_base 139: mod_base = OTHER; note = uracil
  modified_base 145: mod_base = OTHER; note = uracil
  modified_base 147: mod_base = OTHER; note = uracil
  modified_base 153: mod_base = OTHER; note = uracil
  modified_base 169: mod_base = OTHER; note = uracil
  modified_base 170: mod_base = OTHER; note = uracil
  modified_base 181: mod_base = OTHER; note = uracil
  modified_base 182: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 213: mod_base = OTHER; note = uracil
  modified_base 219: mod_base = OTHER; note = uracil
  modified_base 221: mod_base = OTHER; note = uracil
  modified_base 229: mod_base = OTHER; note = uracil
  modified_base 235: mod_base = OTHER; note = uracil
  modified_base 237: mod_base = OTHER; note = uracil
  modified_base 245: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 268: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 288: mod_base = OTHER; note = uracil
  modified_base 292: mod_base = OTHER; note = uracil
  modified_base 297: mod_base = OTHER; note = uracil
  modified_base 300: mod_base = OTHER; note = uracil
tttagaataatggtttggtttgtagagattagaaatgtttattgttgttttttgtatttttttatttatttagattgagtttttgaagttgttyggggtttggagagagaagttatttaaggatagtagttgttgatttagaygtttaaattttygggyggaaaaggattttagagaatgtttaaaatygtggtttaattttttattggaagttggggtttygaaaagtyggggtttygaaaagttgggagagtagtttaaagygtattgtttattaaatgtggatgtaygttggatygt

SEQ ID NO: 32 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 31: mod_base = OTHER; note = uracil
  modified_base 38: mod_base = OTHER; note = uracil
  modified_base 45: mod_base = OTHER; note = uracil
  modified_base 48: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 57: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 73: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 108: mod_base = OTHER; note = uracil
  modified_base 109: mod_base = OTHER; note = uracil
  modified_base 121: mod_base = OTHER; note = uracil
  modified_base 125: mod_base = OTHER; note = uracil
  modified_base 127: mod_base = OTHER; note = uracil
  modified_base 134: mod_base = OTHER; note = uracil
  modified_base 135: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 160: mod_base = OTHER; note = uracil
  modified_base 166: mod_base = OTHER; note = uracil
  modified_base 169: mod_base = OTHER; note = uracil
  modified_base 172: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 189: mod_base = OTHER; note = uracil
  modified_base 192: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 222: mod_base = OTHER; note = uracil
  modified_base 224: mod_base = OTHER; note = uracil
  modified_base 228: mod_base = OTHER; note = uracil
  modified_base 247: mod_base = OTHER; note = uracil
  modified_base 254: mod_base = OTHER; note = uracil
  modified_base 257: mod_base = OTHER; note = uracil
  modified_base 264: mod_base = OTHER; note = uracil
  modified_base 269: mod_base = OTHER; note = uracil
  modified_base 274: mod_base = OTHER; note = uracil
  modified_base 276: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 296: mod_base = OTHER; note = uracil
gyggtttagygtgtatttatatttagtgggtagtaygttttgggttgtttttttagtttttyggagtttyggtttttyggagttttagtttttaatgagggattgggttaygattttaggtattttttaaggttttttttygttygagaatttgagygtttgagttagtagttgttgtttttgagtggtttttttttttaggtttyggatagttttagaggtttagtttgggtgggtggagggatataggaaatagtagtgggtatttttgatttttataaattaggttattattttgga

SEQ ID NO: 33 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 12: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 75: mod_base = OTHER; note = uracil
  modified_base 105: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 120: mod_base = OTHER; note = uracil
  modified_base 122: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 146: mod_base = OTHER; note = uracil
  modified_base 149: mod_base = OTHER; note = uracil
  modified_base 153: mod_base = OTHER; note = uracil
  modified_base 162: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 177: mod_base = OTHER; note = uracil
  modified_base 178: mod_base = OTHER; note = uracil
  modified_base 183: mod_base = OTHER; note = uracil
  modified_base 188: mod_base = OTHER; note = uracil
  modified_base 195: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 232: mod_base = OTHER; note = uracil
  modified_base 236: mod_base = OTHER; note = uracil
  modified_base 240: mod_base = OTHER; note = uracil
  modified_base 245: mod_base = OTHER; note = uracil
  modified_base 246: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 296: mod_base = OTHER; note = uracil
aagttttggggtagaagttggataattagggtttgagaaataaagataagagggtatattttttttttaggagataaaagagaaggtggatggagaaggggaaattgggttttagttagtatygggatgatgygattagttttgttagtaygtttggggagtatatatatygtttgttttggttggatyggagattgtgattattatttttttaatttattttttaataygtaggttggtatggttaygtttatagtgttttaagtgttgtttgttttgtagtgatttattttttttgta

SEQ ID NO: 34 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 17: mod_base = OTHER; note = uracil
  modified_base 19: mod_base = OTHER; note = uracil
  modified_base 22: mod_base = OTHER; note = uracil
  modified_base 27: mod_base = OTHER; note = uracil
  modified_base 31: mod_base = OTHER; note = uracil
  modified_base 34: mod_base = OTHER; note = uracil
  modified_base 36: mod_base = OTHER; note = uracil
  modified_base 43: mod_base = OTHER; note = uracil
  modified_base 45: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 102: mod_base = OTHER; note = uracil
  modified_base 104: mod_base = OTHER; note = uracil
  modified_base 108: mod_base = OTHER; note = uracil
  modified_base 110: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 125: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 153: mod_base = OTHER; note = uracil
  modified_base 157: mod_base = OTHER; note = uracil
  modified_base 162: mod_base = OTHER; note = uracil
  modified_base 169: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 182: mod_base = OTHER; note = uracil
  modified_base 186: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 221: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 256: mod_base = OTHER; note = uracil
  modified_base 264: mod_base = OTHER; note = uracil
  modified_base 266: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 298: mod_base = OTHER; note = uracil
tatagaggaagtgagttattgtaaggtaggtagtatttggggtattgtgggygtggttatgttagtttgygtgttgggggatgggttggaagggtggtgattatagttttyggtttagttaaggtaagyggtgtgtatgttttttaagygtgttgataaagttggtygtattatttyggtgttggttgaggtttagtttttttttttttatttatttttttttttgttttttgggggaggaatatatttttttatttttattttttaggttttggttatttaatttttgttttagaattt

SEQ ID NO: 35 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 46: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 71: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 101: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 116: mod_base = OTHER; note = uracil
  modified_base 120: mod_base = OTHER; note = uracil
  modified_base 121: mod_base = OTHER; note = uracil
  modified_base 126: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 157: mod_base = OTHER; note = uracil
  modified_base 168: mod_base = OTHER; note = uracil
  modified_base 178: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 194: mod_base = OTHER; note = uracil
  modified_base 202: mod_base = OTHER; note = uracil
  modified_base 204: mod_base = OTHER; note = uracil
  modified_base 206: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 238: mod_base = OTHER; note = uracil
  modified_base 242: mod_base = OTHER; note = uracil
  modified_base 244: mod_base = OTHER; note = uracil
  modified_base 249: mod_base = OTHER; note = uracil
  modified_base 252: mod_base = OTHER; note = uracil
  modified_base 266: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 300: mod_base = OTHER; note = uracil
ttagaaygtgtttatatatgtttatgttttttattttgttgaaatttaattttttttttaaaggttattgtagggagtttttttagggtttaatyggatttagtgtttatttgttttgttttgtataaagygttttttttgtttttttygtgtgtatttagagaattttgattttgattgaattatttgtgtatttgtttttttttagttttatttttatatggtgagtttatyggttttatttatttttgtatgaggtaagggtttygtttatattaggtgttaattagtgtttayggt

SEQ ID NO: 36 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 10: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 49: mod_base = OTHER; note = uracil
  modified_base 64: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 92: mod_base = OTHER; note = uracil
  modified_base 103: mod_base = OTHER; note = uracil
  modified_base 109: mod_base = OTHER; note = uracil
  modified_base 111: mod_base = OTHER; note = uracil
  modified_base 120: mod_base = OTHER; note = uracil
  modified_base 124: mod_base = OTHER; note = uracil
  modified_base 130: mod_base = OTHER; note = uracil
  modified_base 137: mod_base = OTHER; note = uracil
  modified_base 139: mod_base = OTHER; note = uracil
  modified_base 146: mod_base = OTHER; note = uracil
  modified_base 148: mod_base = OTHER; note = uracil
  modified_base 159: mod_base = OTHER; note = uracil
  modified_base 170: mod_base = OTHER; note = uracil
  modified_base 177: mod_base = OTHER; note = uracil
  modified_base 182: mod_base = OTHER; note = uracil
  modified_base 187: mod_base = OTHER; note = uracil
  modified_base 195: mod_base = OTHER; note = uracil
  modified_base 197: mod_base = OTHER; note = uracil
  modified_base 203: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 230: mod_base = OTHER; note = uracil
  modified_base 236: mod_base = OTHER; note = uracil
  modified_base 237: mod_base = OTHER; note = uracil
  modified_base 259: mod_base = OTHER; note = uracil
  modified_base 262: mod_base = OTHER; note = uracil
  modified_base 274: mod_base = OTHER; note = uracil
  modified_base 280: mod_base = OTHER; note = uracil
  modified_base 290: mod_base = OTHER; note = uracil
  modified_base 296: mod_base = OTHER; note = uracil
tygtaagtattggttggtatttggtgtgggygagatttttattttatgtagaaatgagtaagatyggtgagtttattatgtgggggtgaggttgagagaaaataagtatataggtgatttagttaaaattagaattttttaagtatataygaaaagggtaaaaggggygttttgtataggatagaataggtagatattgaattyggttgggttttgggaaggttttttgtagtggtttttgaagggggggttggattttagtaggatagagggtatgggtatgtgtgggtaygttttgaa

SEQ ID NO: 37 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 18: mod_base = OTHER; note = uracil
  modified_base 25: mod_base = OTHER; note = uracil
  modified_base 27: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 58: mod_base = OTHER; note = uracil
  modified_base 65: mod_base = OTHER; note = uracil
  modified_base 66: mod_base = OTHER; note = uracil
  modified_base 73: mod_base = OTHER; note = uracil
  modified_base 104: mod_base = OTHER; note = uracil
  modified_base 109: mod_base = OTHER; note = uracil
  modified_base 115: mod_base = OTHER; note = uracil
  modified_base 119: mod_base = OTHER; note = uracil
  modified_base 125: mod_base = OTHER; note = uracil
  modified_base 129: mod_base = OTHER; note = uracil
  modified_base 132: mod_base = OTHER; note = uracil
  modified_base 150: mod_base = OTHER; note = uracil
  modified_base 152: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 165: mod_base = OTHER; note = uracil
  modified_base 172: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 208: mod_base = OTHER; note = uracil
  modified_base 211: mod_base = OTHER; note = uracil
  modified_base 217: mod_base = OTHER; note = uracil
  modified_base 224: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 260: mod_base = OTHER; note = uracil
  modified_base 261: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 286: mod_base = OTHER; note = uracil
  modified_base 287: mod_base = OTHER; note = uracil
  modified_base 299: mod_base = OTHER; note = uracil
tatttygtgttttttatttgtaagtattgtgaggagtagtagtaggaagaaaggagattgggtgttyggtgttatggtggtggtgaaatgggtggggagggggtagaatagatttaggtaggygttggttgtttgagaggtggagygggtataggygtttatygttttatatyggtttttttatttttygttygttygttttaggtatagtyggagtaggtgataggtgataaaatttygtttttttttttattttttatttttttttttttttttttaattatttttgggtagggtata

SEQ ID NO: 38 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 7: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 87: mod_base = OTHER; note = uracil
  modified_base 91: mod_base = OTHER; note = uracil
  modified_base 96: mod_base = OTHER; note = uracil
  modified_base 97: mod_base = OTHER; note = uracil
  modified_base 126: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 190: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 230: mod_base = OTHER; note = uracil
  modified_base 232: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 281: mod_base = OTHER; note = uracil
  modified_base 292: mod_base = OTHER; note = uracil
tgtattttatttaggaatggttggggaggaggaggaagaggtaggaggtaggggagggggyggggttttgttatttgttatttgtttyggttgtgtttagggygggygggyggggagtggggggatyggtataaagyggtaggygtttgtgttygttttattttttaagtagttagygtttgtttgaatttgttttgttttttttttatttattttattattattatgatatygggtatttagttttttttttttttgttgttgttttttatagtgtttataggtgaggggtaygaggtg

SEQ ID NO: 39 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 25: mod_base = OTHER; note = uracil
  modified_base 36: mod_base = OTHER; note = uracil
  modified_base 37: mod_base = OTHER; note = uracil
  modified_base 45: mod_base = OTHER; note = uracil
  modified_base 49: mod_base = OTHER; note = uracil
  modified_base 50: mod_base = OTHER; note = uracil
  modified_base 56: mod_base = OTHER; note = uracil
  modified_base 57: mod_base = OTHER; note = uracil
  modified_base 63: mod_base = OTHER; note = uracil
  modified_base 70: mod_base = OTHER; note = uracil
  modified_base 73: mod_base = OTHER; note = uracil
  modified_base 86: mod_base = OTHER; note = uracil
  modified_base 87: mod_base = OTHER; note = uracil
  modified_base 98: mod_base = OTHER; note = uracil
  modified_base 110: mod_base = OTHER; note = uracil
  modified_base 111: mod_base = OTHER; note = uracil
  modified_base 119: mod_base = OTHER; note = uracil
  modified_base 123: mod_base = OTHER; note = uracil
  modified_base 124: mod_base = OTHER; note = uracil
  modified_base 128: mod_base = OTHER; note = uracil
  modified_base 129: mod_base = OTHER; note = uracil
  modified_base 133: mod_base = OTHER; note = uracil
  modified_base 134: mod_base = OTHER; note = uracil
  modified_base 147: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 173: mod_base = OTHER; note = uracil
  modified_base 179: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 296: mod_base = OTHER; note = uracil
  modified_base 298: mod_base = OTHER; note = uracil
  modified_base 299: mod_base = OTHER; note = uracil
agayggagaaatagaaayggaggttaggyggggagtttyggggataggtttgggattygaggtyggaaatygtagaggagygaagtttggygggatgtagtgattggagttaaaggaatygtttyggtttgtttaaygygggggggttttyggttyggtggttttgagygaatygatgtaygtggtttygtygtattttattttttattttttttagatttttttttttagttttttttgaggyggaaagaaaaattttatatttggttttagttttgggtttttgttttggtttttttt

SEQ ID NO: 40 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 15: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 28: mod_base = OTHER; note = uracil
  modified_base 34: mod_base = OTHER; note = uracil
  modified_base 35: mod_base = OTHER; note = uracil
  modified_base 51: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 70: mod_base = OTHER; note = uracil
  modified_base 84: mod_base = OTHER; note = uracil
  modified_base 116: mod_base = OTHER; note = uracil
  modified_base 117: mod_base = OTHER; note = uracil
  modified_base 123: mod_base = OTHER; note = uracil
  modified_base 133: mod_base = OTHER; note = uracil
  modified_base 135: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 170: mod_base = OTHER; note = uracil
  modified_base 174: mod_base = OTHER; note = uracil
  modified_base 185: mod_base = OTHER; note = uracil
  modified_base 186: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 216: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 235: mod_base = OTHER; note = uracil
  modified_base 239: mod_base = OTHER; note = uracil
  modified_base 240: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 287: mod_base = OTHER; note = uracil
  modified_base 293: mod_base = OTHER; note = uracil
  modified_base 295: mod_base = OTHER; note = uracil
  modified_base 299: mod_base = OTHER; note = uracil
aggaggggttagggtagggatttagggttgggattagatgtagggttttttttttygttttagaaggagttgggagggagagtttggggagggtgggggatgggatgyggyggggttaygtgtatyggttygtttagggttatygggtygaaggttttttygygttggataggtygggayggtttttttggttttaattattgtatttygttaggtttygtttttttgyggttttyggtttygggttttaggtttgttttygaggtttttygtttgattttygtttttgttttttygttt

SEQ ID NO: 41 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 16: mod_base = OTHER; note = uracil
  modified_base 22: mod_base = OTHER; note = uracil
  modified_base 34: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 50: mod_base = OTHER; note = uracil
  modified_base 58: mod_base = OTHER; note = uracil
  modified_base 65: mod_base = OTHER; note = uracil
  modified_base 67: mod_base = OTHER; note = uracil
  modified_base 77: mod_base = OTHER; note = uracil
  modified_base 79: mod_base = OTHER; note = uracil
  modified_base 89: mod_base = OTHER; note = uracil
  modified_base 96: mod_base = OTHER; note = uracil
  modified_base 99: mod_base = OTHER; note = uracil
  modified_base 101: mod_base = OTHER; note = uracil
  modified_base 106: mod_base = OTHER; note = uracil
  modified_base 111: mod_base = OTHER; note = uracil
  modified_base 112: mod_base = OTHER; note = uracil
  modified_base 117: mod_base = OTHER; note = uracil
  modified_base 118: mod_base = OTHER; note = uracil
  modified_base 122: mod_base = OTHER; note = uracil
  modified_base 128: mod_base = OTHER; note = uracil
  modified_base 130: mod_base = OTHER; note = uracil
  modified_base 132: mod_base = OTHER; note = uracil
  modified_base 134: mod_base = OTHER; note = uracil
  modified_base 137: mod_base = OTHER; note = uracil
  modified_base 140: mod_base = OTHER; note = uracil
  modified_base 147: mod_base = OTHER; note = uracil
  modified_base 153: mod_base = OTHER; note = uracil
  modified_base 156: mod_base = OTHER; note = uracil
  modified_base 158: mod_base = OTHER; note = uracil
  modified_base 166: mod_base = OTHER; note = uracil
  modified_base 174: mod_base = OTHER; note = uracil
  modified_base 178: mod_base = OTHER; note = uracil
  modified_base 180: mod_base = OTHER; note = uracil
  modified_base 182: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 219: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 237: mod_base = OTHER; note = uracil
  modified_base 243: mod_base = OTHER; note = uracil
  modified_base 247: mod_base = OTHER; note = uracil
  modified_base 248: mod_base = OTHER; note = uracil
  modified_base 257: mod_base = OTHER; note = uracil
  modified_base 261: mod_base = OTHER; note = uracil
  modified_base 262: mod_base = OTHER; note = uracil
  modified_base 270: mod_base = OTHER; note = uracil
  modified_base 272: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 297: mod_base = OTHER; note = uracil
  modified_base 299: mod_base = OTHER; note = uracil
  modified_base 300: mod_base = OTHER; note = uracil
ttaaatttaggtattttgggtttagtyggtgtttttttgttaaagagtattttgtggttaaatttattggatgtgatttagtttttatttttygttattttttagttttgttttatttaaatyggattatttttttttgtttagaattygttttgtttttggtgatagtggtatatatttttatattgtttttttttttgtttagagttttttttttttatgttttattttttttattgggatyggtttgggtgtgttgtttaatyggatattattttgttgggtttttttttttatttt

SEQ ID NO: 42 - DNA, 300 bp, synthetic construct
  misc_feature 1..300: note = Synthetic polynucleotide
  source 1..300: mol_type = other DNA
  modified_base 16: mod_base = OTHER; note = uracil
  modified_base 17: mod_base = OTHER; note = uracil
  modified_base 18: mod_base = OTHER; note = uracil
  modified_base 21: mod_base = OTHER; note = uracil
  modified_base 32: mod_base = OTHER; note = uracil
  modified_base 41: mod_base = OTHER; note = uracil
  modified_base 44: mod_base = OTHER; note = uracil
  modified_base 46: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 54: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 78: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 112: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 145: mod_base = OTHER; note = uracil
  modified_base 156: mod_base = OTHER; note = uracil
  modified_base 161: mod_base = OTHER; note = uracil
  modified_base 175: mod_base = OTHER; note = uracil
  modified_base 190: mod_base = OTHER; note = uracil
  modified_base 195: mod_base = OTHER; note = uracil
  modified_base 219: mod_base = OTHER; note = uracil
  modified_base 225: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 253: mod_base = OTHER; note = uracil
  modified_base 255: mod_base = OTHER; note = uracil
  modified_base 261: mod_base = OTHER; note = uracil
  modified_base 269: mod_base = OTHER; note = uracil
  modified_base 271: mod_base = OTHER; note = uracil
  modified_base 275: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 289: mod_base = OTHER; note = uracil
  modified_base 290: mod_base = OTHER; note = uracil
  modified_base 300: mod_base = OTHER; note = uracil
gagtgaaggagagggtttaataaaatagtgttygattggatagtatatttaggtyggttttagtagaggaggtggaatatgagaaggaaggattttgggtaagggaagaggtagtatgagagtatgtattattgttattaagagtagaaygagttttaagtagaagagagtgattyggtttggataaggtaaagttaagagatgaygaaagataaaaattgagttatatttagtgaatttagttataaagtattttttggtagaagaatatygattagatttagaatatttgggtttgat

SEQ ID NO: 43 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 33: mod_base = OTHER; note = uracil
  modified_base 40: mod_base = OTHER; note = uracil
  modified_base 47: mod_base = OTHER; note = uracil
  modified_base 51: mod_base = OTHER; note = uracil
  modified_base 59: mod_base = OTHER; note = uracil
  modified_base 74: mod_base = OTHER; note = uracil
  modified_base 76: mod_base = OTHER; note = uracil
  modified_base 78: mod_base = OTHER; note = uracil
  modified_base 80: mod_base = OTHER; note = uracil
  modified_base 82: mod_base = OTHER; note = uracil
  modified_base 85: mod_base = OTHER; note = uracil
  modified_base 92: mod_base = OTHER; note = uracil
  modified_base 97: mod_base = OTHER; note = uracil
  modified_base 104: mod_base = OTHER; note = uracil
  modified_base 106: mod_base = OTHER; note = uracil
  modified_base 108: mod_base = OTHER; note = uracil
  modified_base 111: mod_base = OTHER; note = uracil
  modified_base 115: mod_base = OTHER; note = uracil
  modified_base 128: mod_base = OTHER; note = uracil
  modified_base 141: mod_base = OTHER; note = uracil
  modified_base 147: mod_base = OTHER; note = uracil
  modified_base 148: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 189: mod_base = OTHER; note = uracil
  modified_base 192: mod_base = OTHER; note = uracil
  modified_base 193: mod_base = OTHER; note = uracil
aagtgtttttattttttgagtgygatttaagttaggaggtaggaggttgattgagggatayggaggaggtatgtatatttatagtatgaggtagagttgtgtgtatatattaagtaaggaaatggggtyggaatatggggtaaaggtttayggattgaatggtggatttggatgtgggttattttttttagtttttgaaagaggattaggtaatgtggttatgaatgggtttaatgagaattgattgattygttygagatgttttttttttttttttaaaatagaaaatgatatatttta

SEQ ID NO: 44 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 17: mod_base = OTHER; note = uracil
  modified_base 40: mod_base = OTHER; note = uracil
  modified_base 43: mod_base = OTHER; note = uracil
  modified_base 54: mod_base = OTHER; note = uracil
  modified_base 58: mod_base = OTHER; note = uracil
  modified_base 63: mod_base = OTHER; note = uracil
  modified_base 65: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 104: mod_base = OTHER; note = uracil
  modified_base 110: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 144: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 170: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 182: mod_base = OTHER; note = uracil
  modified_base 183: mod_base = OTHER; note = uracil
  modified_base 187: mod_base = OTHER; note = uracil
  modified_base 198: mod_base = OTHER; note = uracil
  modified_base 200: mod_base = OTHER; note = uracil
  modified_base 202: mod_base = OTHER; note = uracil
  modified_base 205: mod_base = OTHER; note = uracil
  modified_base 207: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 217: mod_base = OTHER; note = uracil
  modified_base 228: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 270: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 296: mod_base = OTHER; note = uracil
  modified_base 298: mod_base = OTHER; note = uracil
tggggtatgttattttttattttaggaagaaaaagaaaatatttygagygaattaattaatttttattaggtttatttatagttatattgtttggtttttttttaggggttggaagaagtggtttatatttaaatttattatttaattygtaggtttttgttttatatttyggttttatttttttgtttgatgtgtgtatatagttttgttttatgttgtgagtgtgtatatttttttygtgttttttagttagttttttgttttttgatttgggtygtatttaggaggtaaagatattt

SEQ ID NO: 45 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 10: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 38: mod_base = OTHER; note = uracil
  modified_base 40: mod_base = OTHER; note = uracil
  modified_base 45: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 66: mod_base = OTHER; note = uracil
  modified_base 82: mod_base = OTHER; note = uracil
  modified_base 84: mod_base = OTHER; note = uracil
  modified_base 87: mod_base = OTHER; note = uracil
  modified_base 94: mod_base = OTHER; note = uracil
  modified_base 98: mod_base = OTHER; note = uracil
  modified_base 101: mod_base = OTHER; note = uracil
  modified_base 104: mod_base = OTHER; note = uracil
  modified_base 114: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 143: mod_base = OTHER; note = uracil
  modified_base 145: mod_base = OTHER; note = uracil
  modified_base 149: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 199: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 242: mod_base = OTHER; note = uracil
  modified_base 246: mod_base = OTHER; note = uracil
  modified_base 259: mod_base = OTHER; note = uracil
  modified_base 283: mod_base = OTHER; note = uracil
  modified_base 289: mod_base = OTHER; note = uracil
  modified_base 291: mod_base = OTHER; note = uracil
  modified_base 293: mod_base = OTHER; note = uracil
  modified_base 298: mod_base = OTHER; note = uracil
  modified_base 300: mod_base = OTHER; note = uracil
ggatgtgtttaggttttagggttatattttgtatgtatttatagtatagtttattttggaaggtgtagtagagtttgggggtatagttgtgtgttygtagtagttggaagtttttgattttattttttyggtttattagtagtttygttygttttttatatattyggattagtaygtagttttgtatgtttttttttatatagtaggttattagtttgttggtgatgttattygtgaagygttagtatggggagaggatagtgygtgggtgggtgggtggggtaggatttttttggtttt

SEQ ID NO: 46 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 15: mod_base = OTHER; note = uracil
  modified_base 16: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 62: mod_base = OTHER; note = uracil
  modified_base 65: mod_base = OTHER; note = uracil
  modified_base 74: mod_base = OTHER; note = uracil
  modified_base 77: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 87: mod_base = OTHER; note = uracil
  modified_base 94: mod_base = OTHER; note = uracil
  modified_base 95: mod_base = OTHER; note = uracil
  modified_base 98: mod_base = OTHER; note = uracil
  modified_base 113: mod_base = OTHER; note = uracil
  modified_base 117: mod_base = OTHER; note = uracil
  modified_base 122: mod_base = OTHER; note = uracil
  modified_base 129: mod_base = OTHER; note = uracil
  modified_base 134: mod_base = OTHER; note = uracil
  modified_base 159: mod_base = OTHER; note = uracil
  modified_base 162: mod_base = OTHER; note = uracil
  modified_base 170: mod_base = OTHER; note = uracil
  modified_base 185: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 201: mod_base = OTHER; note = uracil
  modified_base 208: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 228: mod_base = OTHER; note = uracil
  modified_base 230: mod_base = OTHER; note = uracil
  modified_base 233: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 242: mod_base = OTHER; note = uracil
  modified_base 243: mod_base = OTHER; note = uracil
  modified_base 252: mod_base = OTHER; note = uracil
  modified_base 257: mod_base = OTHER; note = uracil
  modified_base 266: mod_base = OTHER; note = uracil
  modified_base 270: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 288: mod_base = OTHER; note = uracil
  modified_base 289: mod_base = OTHER; note = uracil
  modified_base 294: mod_base = OTHER; note = uracil
  modified_base 296: mod_base = OTHER; note = uracil
  modified_base 299: mod_base = OTHER; note = uracil
  modified_base 300: mod_base = OTHER; note = uracil
gagattagagagattttgttttatttatttatttaygtattgttttttttttatgttagygttttayggatggtattattaataagttggtggtttgttatgtggaggaggatatgtaggattgygtgttggttygggtgtatggggagyggayggagttgttggtggatygggagaatgaggttagaaatttttagttgttgygagtatatagttgtgtttttaaattttattgtattttttagaatgggttgtgttatgagtatatgtagggtgtggttttggagtttgagtatattt

SEQ ID NO: 47 - DNA, 301 bp, synthetic construct
  misc_feature 1..301: note = Synthetic polynucleotide
  source 1..301: mol_type = other DNA
  modified_base 3: mod_base = OTHER; note = uracil
  modified_base 4: mod_base = OTHER; note = uracil
  modified_base 13: mod_base = OTHER; note = uracil
  modified_base 16: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 31: mod_base = OTHER; note = uracil
  modified_base 36: mod_base = OTHER; note = uracil
  modified_base 40: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 55: mod_base = OTHER; note = uracil
  modified_base 61: mod_base = OTHER; note = uracil
  modified_base 66: mod_base = OTHER; note = uracil
  modified_base 68: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 90: mod_base = OTHER; note = uracil
  modified_base 94: mod_base = OTHER; note = uracil
  modified_base 120: mod_base = OTHER; note = uracil
  modified_base 127: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 178: mod_base = OTHER; note = uracil
  modified_base 184: mod_base = OTHER; note = uracil
  modified_base 195: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 231: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 285: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 296: mod_base = OTHER; note = uracil
  modified_base 301: mod_base = OTHER; note = uracil
agttaggaagggttgtatttttttagtggttagygtaggttggygttttggttgttggygtaagttttaagttgtttttttttttttagtaagtatgggyggtgtgggtatgyggggtgttgggtattgatttattttyggagattattyggtttttatatattatttttgaatgatttgaattatttatgaggttgaatgttttgttttttagggagttttagttggagttggagttagtatatggaggtggagagagttttygtagttattygggttttgtatagtttgtaggtagaat

SEQ ID NO: 48 - DNA, 301 bp, synthetic construct
  misc_feature 1..301: note = Synthetic polynucleotide
  source 1..301: mol_type = other DNA
  modified_base 4: mod_base = OTHER; note = uracil
  modified_base 7: mod_base = OTHER; note = uracil
  modified_base 8: mod_base = OTHER; note = uracil
  modified_base 11: mod_base = OTHER; note = uracil
  modified_base 15: mod_base = OTHER; note = uracil
  modified_base 20: mod_base = OTHER; note = uracil
  modified_base 25: mod_base = OTHER; note = uracil
  modified_base 26: mod_base = OTHER; note = uracil
  modified_base 34: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 55: mod_base = OTHER; note = uracil
  modified_base 56: mod_base = OTHER; note = uracil
  modified_base 62: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 96: mod_base = OTHER; note = uracil
  modified_base 101: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 122: mod_base = OTHER; note = uracil
  modified_base 127: mod_base = OTHER; note = uracil
  modified_base 131: mod_base = OTHER; note = uracil
  modified_base 150: mod_base = OTHER; note = uracil
  modified_base 159: mod_base = OTHER; note = uracil
  modified_base 161: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 209: mod_base = OTHER; note = uracil
  modified_base 213: mod_base = OTHER; note = uracil
  modified_base 228: mod_base = OTHER; note = uracil
  modified_base 231: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 273: mod_base = OTHER; note = uracil
  modified_base 274: mod_base = OTHER; note = uracil
  modified_base 276: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 296: mod_base = OTHER; note = uracil
  modified_base 300: mod_base = OTHER; note = uracil
gttttgtttgtaggttgtatagggttygggtgattgygggagttttttttatttttatatgttggttttagttttagttggagttttttggaggatagggtatttagttttataaatgatttagattatttagaggtggtgtgtgggagtygagtggttttyggaggtgagttagtatttagtatttygtatatttatatygtttatgtttgttagaaggggaggggtagtttgagatttgygttagtagttaggaygttagtttgygttgattattggggaagtgtagttttttttggtt

SEQ ID NO: 49 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 13: mod_base = OTHER; note = uracil
  modified_base 17: mod_base = OTHER; note = uracil
  modified_base 19: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 39: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 55: mod_base = OTHER; note = uracil
  modified_base 64: mod_base = OTHER; note = uracil
  modified_base 70: mod_base = OTHER; note = uracil
  modified_base 81: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 98: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 111: mod_base = OTHER; note = uracil
  modified_base 117: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 171: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 182: mod_base = OTHER; note = uracil
  modified_base 187: mod_base = OTHER; note = uracil
  modified_base 188: mod_base = OTHER; note = uracil
  modified_base 195: mod_base = OTHER; note = uracil
  modified_base 200: mod_base = OTHER; note = uracil
  modified_base 202: mod_base = OTHER; note = uracil
  modified_base 203: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 219: mod_base = OTHER; note = uracil
  modified_base 224: mod_base = OTHER; note = uracil
  modified_base 225: mod_base = OTHER; note = uracil
  modified_base 234: mod_base = OTHER; note = uracil
  modified_base 237: mod_base = OTHER; note = uracil
  modified_base 245: mod_base = OTHER; note = uracil
  modified_base 247: mod_base = OTHER; note = uracil
  modified_base 249: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 264: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 285: mod_base = OTHER; note = uracil
  modified_base 293: mod_base = OTHER; note = uracil
  modified_base 294: mod_base = OTHER; note = uracil
  modified_base 295: mod_base = OTHER; note = uracil
gggtgttgggtattgatttattttyggagattattyggtttttatatattatttttgaatgatttgaattatttatgaggttgaatgttttgttttttagggagttttagttggagttggagttagtatatggaggtggagagagttttygtagttattygggttttgtatagtttgtaggtagaatttataaattggatttttaaagttattttttttaaggtttggagattttgttgagttttattttttggtttttagagtatttggaattttatataaagttgaggaattttttgt

SEQ ID NO: 50 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 17: mod_base = OTHER; note = uracil
  modified_base 31: mod_base = OTHER; note = uracil
  modified_base 32: mod_base = OTHER; note = uracil
  modified_base 38: mod_base = OTHER; note = uracil
  modified_base 40: mod_base = OTHER; note = uracil
  modified_base 47: mod_base = OTHER; note = uracil
  modified_base 48: mod_base = OTHER; note = uracil
  modified_base 60: mod_base = OTHER; note = uracil
  modified_base 62: mod_base = OTHER; note = uracil
  modified_base 65: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 79: mod_base = OTHER; note = uracil
  modified_base 93: mod_base = OTHER; note = uracil
  modified_base 103: mod_base = OTHER; note = uracil
  modified_base 104: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 128: mod_base = OTHER; note = uracil
  modified_base 133: mod_base = OTHER; note = uracil
  modified_base 138: mod_base = OTHER; note = uracil
  modified_base 139: mod_base = OTHER; note = uracil
  modified_base 147: mod_base = OTHER; note = uracil
  modified_base 156: mod_base = OTHER; note = uracil
  modified_base 158: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 175: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 209: mod_base = OTHER; note = uracil
  modified_base 214: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 235: mod_base = OTHER; note = uracil
  modified_base 240: mod_base = OTHER; note = uracil
  modified_base 244: mod_base = OTHER; note = uracil
  modified_base 263: mod_base = OTHER; note = uracil
  modified_base 272: mod_base = OTHER; note = uracil
  modified_base 274: mod_base = OTHER; note = uracil
  modified_base 286: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 296: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ataaagggttttttagttttatgtagagttttagatgttttgagagttaaagagtgaaatttagtagaatttttaggttttgagaggagtggttttaggagtttagtttataggttttgtttgtaggttgtatagggttygggtgattgygggagttttttttatttttatatgttggttttagttttagttggagttttttggaggatagggtatttagttttataaatgatttagattatttagaggtggtgtgtgggagtygagtggttttyggaggtgagttagtatttagtattt

SEQ ID NO: 51 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 13: mod_base = OTHER; note = uracil
  modified_base 15: mod_base = OTHER; note = uracil
  modified_base 21: mod_base = OTHER; note = uracil
  modified_base 35: mod_base = OTHER; note = uracil
  modified_base 37: mod_base = OTHER; note = uracil
  modified_base 38: mod_base = OTHER; note = uracil
  modified_base 45: mod_base = OTHER; note = uracil
  modified_base 53: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 68: mod_base = OTHER; note = uracil
  modified_base 77: mod_base = OTHER; note = uracil
  modified_base 85: mod_base = OTHER; note = uracil
  modified_base 86: mod_base = OTHER; note = uracil
  modified_base 92: mod_base = OTHER; note = uracil
  modified_base 109: mod_base = OTHER; note = uracil
  modified_base 118: mod_base = OTHER; note = uracil
  modified_base 122: mod_base = OTHER; note = uracil
  modified_base 127: mod_base = OTHER; note = uracil
  modified_base 130: mod_base = OTHER; note = uracil
  modified_base 135: mod_base = OTHER; note = uracil
  modified_base 139: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 171: mod_base = OTHER; note = uracil
  modified_base 180: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 195: mod_base = OTHER; note = uracil
  modified_base 196: mod_base = OTHER; note = uracil
  modified_base 203: mod_base = OTHER; note = uracil
  modified_base 206: mod_base = OTHER; note = uracil
  modified_base 209: mod_base = OTHER; note = uracil
  modified_base 211: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 246: mod_base = OTHER; note = uracil
  modified_base 249: mod_base = OTHER; note = uracil
  modified_base 253: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 282: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 296: mod_base = OTHER; note = uracil
agtttatgaaggtatttttttaaagttaggtggttattaaaaaataggtaattaattttgttattagtygyggggatagygaggttttgggtttggagggggaggatgtygaygatgtygatygygtattagatttygtygggaggagggygygggygttttatttgttgtaaagaaygtygggtttttttgggttattgggttgtygtttyggyggggagygyggaaggttgggttttaggtagttttaattatttatttgttggttaygggtygyggygtyggggattttatttygga

SEQ ID NO: 52 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 22: mod_base = OTHER; note = uracil
  modified_base 28: mod_base = OTHER; note = uracil
  modified_base 29: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 117: mod_base = OTHER; note = uracil
  modified_base 118: mod_base = OTHER; note = uracil
  modified_base 126: mod_base = OTHER; note = uracil
  modified_base 131: mod_base = OTHER; note = uracil
  modified_base 134: mod_base = OTHER; note = uracil
  modified_base 145: mod_base = OTHER; note = uracil
  modified_base 146: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 169: mod_base = OTHER; note = uracil
  modified_base 184: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 217: mod_base = OTHER; note = uracil
  modified_base 218: mod_base = OTHER; note = uracil
  modified_base 222: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 234: mod_base = OTHER; note = uracil
  modified_base 241: mod_base = OTHER; note = uracil
  modified_base 253: mod_base = OTHER; note = uracil
  modified_base 254: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 276: mod_base = OTHER; note = uracil
  modified_base 289: mod_base = OTHER; note = uracil
  modified_base 290: mod_base = OTHER; note = uracil
  modified_base 293: mod_base = OTHER; note = uracil
  modified_base 299: mod_base = OTHER; note = uracil
ttyggagtagggttttyggygtygygattygtaattagtaggtgaatgattgaagttatttgaggtttagtttttygygtttttygtyggagyggtagtttaatggtttagaggaattyggygttttttgtaataagtggagygttygygtttttttttyggygagatttgatgygyggtyggtatygtyggtattttttttttttaagtttaaggtttygttgttttygyggttggtgataggattgattatttgttttttggtgattatttaattttgaaaaagtgtttttatggatt

SEQ ID NO: 53 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 6: mod_base = OTHER; note = uracil
  modified_base 9: mod_base = OTHER; note = uracil
  modified_base 32: mod_base = OTHER; note = uracil
  modified_base 49: mod_base = OTHER; note = uracil
  modified_base 50: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 79: mod_base = OTHER; note = uracil
  modified_base 83: mod_base = OTHER; note = uracil
  modified_base 90: mod_base = OTHER; note = uracil
  modified_base 91: mod_base = OTHER; note = uracil
  modified_base 102: mod_base = OTHER; note = uracil
  modified_base 103: mod_base = OTHER; note = uracil
  modified_base 111: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 121: mod_base = OTHER; note = uracil
  modified_base 132: mod_base = OTHER; note = uracil
  modified_base 138: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 175: mod_base = OTHER; note = uracil
  modified_base 178: mod_base = OTHER; note = uracil
  modified_base 188: mod_base = OTHER; note = uracil
  modified_base 189: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 205: mod_base = OTHER; note = uracil
  modified_base 214: mod_base = OTHER; note = uracil
  modified_base 216: mod_base = OTHER; note = uracil
  modified_base 220: mod_base = OTHER; note = uracil
  modified_base 222: mod_base = OTHER; note = uracil
  modified_base 225: mod_base = OTHER; note = uracil
  modified_base 229: mod_base = OTHER; note = uracil
  modified_base 239: mod_base = OTHER; note = uracil
  modified_base 243: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 266: mod_base = OTHER; note = uracil
  modified_base 267: mod_base = OTHER; note = uracil
  modified_base 272: mod_base = OTHER; note = uracil
  modified_base 273: mod_base = OTHER; note = uracil
  modified_base 276: mod_base = OTHER; note = uracil
  modified_base 277: mod_base = OTHER; note = uracil
  modified_base 283: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 294: mod_base = OTHER; note = uracil
gtttgtagttgggaatgaatggaatgaaggttaaggatgaagtaataattaaatattgggttttgggtgttttggtaattgttyggtttttagttagggtttttgggtgatattttttttttgggggaagatagagttaaatgagaaaygtgagttgagtttaggggaaaggattattygggagatgtttgaggggttttagggtatygtaattttttgtttagttggtagagtggggttgatayggttagttgttttttggagttttyggtttttttgtttttttttgaggattttgag

SEQ ID NO: 54 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 9: mod_base = OTHER; note = uracil
  modified_base 11: mod_base = OTHER; note = uracil
  modified_base 21: mod_base = OTHER; note = uracil
  modified_base 29: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 46: mod_base = OTHER; note = uracil
  modified_base 49: mod_base = OTHER; note = uracil
  modified_base 53: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 81: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 128: mod_base = OTHER; note = uracil
  modified_base 129: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 141: mod_base = OTHER; note = uracil
  modified_base 143: mod_base = OTHER; note = uracil
  modified_base 146: mod_base = OTHER; note = uracil
  modified_base 148: mod_base = OTHER; note = uracil
  modified_base 155: mod_base = OTHER; note = uracil
  modified_base 157: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 214: mod_base = OTHER; note = uracil
  modified_base 219: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 283: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 295: mod_base = OTHER; note = uracil
  modified_base 299: mod_base = OTHER; note = uracil
ttaaagtttttagggggaaataggaaggtygaggattttagagagtagttggtygtgttagttttattttgttagttgagtaagagattaygatgttttggagttttttaggtatttttyggatgatttttttttttgggtttaatttaygttttttatttgattttgtttttttttagaaggaagatgttatttaggaattttaattggaaatyggatagttattagggtatttaaaatttaatatttggttattattttatttttgatttttattttatttatttttagttgtagata

SEQ ID NO: 55 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 7: mod_base = OTHER; note = uracil
  modified_base 12: mod_base = OTHER; note = uracil
  modified_base 16: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 30: mod_base = OTHER; note = uracil
  modified_base 34: mod_base = OTHER; note = uracil
  modified_base 35: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 55: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 70: mod_base = OTHER; note = uracil
  modified_base 73: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 84: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 105: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 127: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 149: mod_base = OTHER; note = uracil
  modified_base 150: mod_base = OTHER; note = uracil
  modified_base 165: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 188: mod_base = OTHER; note = uracil
  modified_base 190: mod_base = OTHER; note = uracil
  modified_base 192: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 203: mod_base = OTHER; note = uracil
  modified_base 207: mod_base = OTHER; note = uracil
  modified_base 210: mod_base = OTHER; note = uracil
  modified_base 212: mod_base = OTHER; note = uracil
  modified_base 225: mod_base = OTHER; note = uracil
  modified_base 235: mod_base = OTHER; note = uracil
  modified_base 239: mod_base = OTHER; note = uracil
  modified_base 259: mod_base = OTHER; note = uracil
  modified_base 261: mod_base = OTHER; note = uracil
  modified_base 263: mod_base = OTHER; note = uracil
  modified_base 269: mod_base = OTHER; note = uracil
  modified_base 272: mod_base = OTHER; note = uracil
  modified_base 291: mod_base = OTHER; note = uracil
  modified_base 292: mod_base = OTHER; note = uracil
  modified_base 293: mod_base = OTHER; note = uracil
ttagtgtagaataggtattgtttattatataggttagaagaggtgttttttttatattggttattgaaattatttattggtagtagtgggtgttatttggaaaataagatggttttttttgtagagtaggttattttgtyggaggtgtttygatgygtgtgaagtagggttggaggtatattataggtattttttagttttttaaataatattgtagtgtagattttgttggtttttttagagaaggggaaayggaaatttatagaagtaattagaggagtgagtagaagtttaggtatg

SEQ ID NO: 56 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 11: mod_base = OTHER; note = uracil
  modified_base 14: mod_base = OTHER; note = uracil
  modified_base 17: mod_base = OTHER; note = uracil
  modified_base 19: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 33: mod_base = OTHER; note = uracil
  modified_base 36: mod_base = OTHER; note = uracil
  modified_base 46: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 60: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 79: mod_base = OTHER; note = uracil
  modified_base 82: mod_base = OTHER; note = uracil
  modified_base 84: mod_base = OTHER; note = uracil
  modified_base 87: mod_base = OTHER; note = uracil
  modified_base 104: mod_base = OTHER; note = uracil
  modified_base 114: mod_base = OTHER; note = uracil
  modified_base 115: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 140: mod_base = OTHER; note = uracil
  modified_base 142: mod_base = OTHER; note = uracil
  modified_base 146: mod_base = OTHER; note = uracil
  modified_base 154: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 163: mod_base = OTHER; note = uracil
  modified_base 171: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 180: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 201: mod_base = OTHER; note = uracil
  modified_base 202: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 235: mod_base = OTHER; note = uracil
  modified_base 241: mod_base = OTHER; note = uracil
  modified_base 242: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 261: mod_base = OTHER; note = uracil
  modified_base 264: mod_base = OTHER; note = uracil
  modified_base 268: mod_base = OTHER; note = uracil
  modified_base 269: mod_base = OTHER; note = uracil
  modified_base 281: mod_base = OTHER; note = uracil
  modified_base 286: mod_base = OTHER; note = uracil
  modified_base 287: mod_base = OTHER; note = uracil
  modified_base 292: mod_base = OTHER; note = uracil
  modified_base 295: mod_base = OTHER; note = uracil
  modified_base 297: mod_base = OTHER; note = uracil
tatatttgggtttttatttatttttttagttgtttttgtgagttttygtttttttttttttgaaagaattaataagatttatattatagtgttgtttgaaggattagagagtgtttgtagtgtgtttttaattttgttttataygtatygggatattttyggtagggtggtttgttttgtagggagggttattttgttttttaagtggtatttattgttgttagtgagtagttttagtggttagtgtggagagggtattttttttggtttgtatggtgggtagtgtttgttttgtattgg

SEQ ID NO: 57 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 9: mod_base = OTHER; note = uracil
  modified_base 14: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 46: mod_base = OTHER; note = uracil
  modified_base 49: mod_base = OTHER; note = uracil
  modified_base 52: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 92: mod_base = OTHER; note = uracil
  modified_base 98: mod_base = OTHER; note = uracil
  modified_base 100: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 113: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 130: mod_base = OTHER; note = uracil
  modified_base 134: mod_base = OTHER; note = uracil
  modified_base 136: mod_base = OTHER; note = uracil
  modified_base 145: mod_base = OTHER; note = uracil
  modified_base 147: mod_base = OTHER; note = uracil
  modified_base 154: mod_base = OTHER; note = uracil
  modified_base 155: mod_base = OTHER; note = uracil
  modified_base 162: mod_base = OTHER; note = uracil
  modified_base 163: mod_base = OTHER; note = uracil
  modified_base 171: mod_base = OTHER; note = uracil
  modified_base 178: mod_base = OTHER; note = uracil
  modified_base 183: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 256: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 271: mod_base = OTHER; note = uracil
  modified_base 274: mod_base = OTHER; note = uracil
  modified_base 283: mod_base = OTHER; note = uracil
  modified_base 286: mod_base = OTHER; note = uracil
  modified_base 287: mod_base = OTHER; note = uracil
  modified_base 289: mod_base = OTHER; note = uracil
ttyggtattaatttttaatgagttttygagttttygtagttttgtttatttttttttttttttagtgaatttttatagttttttttttttgtatgttttttgttttaaatttttgaagttttttttttttygttttttaagaatttttaygaattygaaagttygtgaggttgatggtaygtttgtggttttttttttttttttttttttatatttatagtttttygggatyggattttttttatttattaggtgtagggttaggggtagtagtaggaggaatagttataggtagaggtg

SEQ ID NO: 58 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 16: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 28: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 48: mod_base = OTHER; note = uracil
  modified_base 49: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 81: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 140: mod_base = OTHER; note = uracil
  modified_base 160: mod_base = OTHER; note = uracil
  modified_base 183: mod_base = OTHER; note = uracil
  modified_base 186: mod_base = OTHER; note = uracil
  modified_base 199: mod_base = OTHER; note = uracil
  modified_base 206: mod_base = OTHER; note = uracil
  modified_base 210: mod_base = OTHER; note = uracil
  modified_base 223: mod_base = OTHER; note = uracil
  modified_base 234: mod_base = OTHER; note = uracil
  modified_base 236: mod_base = OTHER; note = uracil
  modified_base 257: mod_base = OTHER; note = uracil
  modified_base 262: mod_base = OTHER; note = uracil
  modified_base 271: mod_base = OTHER; note = uracil
  modified_base 279: mod_base = OTHER; note = uracil
  modified_base 281: mod_base = OTHER; note = uracil
  modified_base 296: mod_base = OTHER; note = uracil
tatttttatttgtggttgttttttttgttgttgtttttggttttgtatttggtgagtggggagggttyggtttyggggagttgtgggtatggagggaagaaggagaaaggaattatagaygtgttattagttttaygggttttygggttygtagagatttttaagagayggaaagggaggggttttagaaatttgggatagagaatatgtagggaaaggggattgtgaggatttattggaaaagaaaagaagtagataggattgygggggttyggggatttattaagaattgatgtygga

SEQ ID NO: 59 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 9: mod_base = OTHER; note = uracil
  modified_base 11: mod_base = OTHER; note = uracil
  modified_base 20: mod_base = OTHER; note = uracil
  modified_base 33: mod_base = OTHER; note = uracil
  modified_base 36: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 64: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 93: mod_base = OTHER; note = uracil
  modified_base 94: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 120: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 139: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 163: mod_base = OTHER; note = uracil
  modified_base 174: mod_base = OTHER; note = uracil
  modified_base 181: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 205: mod_base = OTHER; note = uracil
  modified_base 209: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 235: mod_base = OTHER; note = uracil
  modified_base 238: mod_base = OTHER; note = uracil
  modified_base 244: mod_base = OTHER; note = uracil
  modified_base 246: mod_base = OTHER; note = uracil
  modified_base 250: mod_base = OTHER; note = uracil
  modified_base 254: mod_base = OTHER; note = uracil
  modified_base 257: mod_base = OTHER; note = uracil
  modified_base 263: mod_base = OTHER; note = uracil
  modified_base 268: mod_base = OTHER; note = uracil
  modified_base 276: mod_base = OTHER; note = uracil
  modified_base 279: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 295: mod_base = OTHER; note = uracil
  modified_base 296: mod_base = OTHER; note = uracil
agtttgtgtttaggaataattaaggagtggagtygtattaattttttttttaaattyggaygttttttttygatttaagtttagtttgagggttattttttttgatttatttttggaaatagatattagttaagggagttgttttttggygttgaygaggattygatttaggttagtattttagtttttattttatagaggaatttgattggaggttagttgtggtygatgagttattyggaatataagtaggtagttattttygaattaaatggtatttgatttttttttttattttga

SEQ ID NO: 60 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 20: mod_base = OTHER; note = uracil
  modified_base 26: mod_base = OTHER; note = uracil
  modified_base 27: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 60: mod_base = OTHER; note = uracil
  modified_base 68: mod_base = OTHER; note = uracil
  modified_base 70: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 82: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 117: mod_base = OTHER; note = uracil
  modified_base 125: mod_base = OTHER; note = uracil
  modified_base 129: mod_base = OTHER; note = uracil
  modified_base 130: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 172: mod_base = OTHER; note = uracil
  modified_base 179: mod_base = OTHER; note = uracil
  modified_base 185: mod_base = OTHER; note = uracil
  modified_base 186: mod_base = OTHER; note = uracil
  modified_base 197: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 217: mod_base = OTHER; note = uracil
  modified_base 222: mod_base = OTHER; note = uracil
  modified_base 242: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 295: mod_base = OTHER; note = uracil
  modified_base 299: mod_base = OTHER; note = uracil
ttaaggtgaggagggagattagatgttatttagttyggaaatagttgtttgtttgtgtttyggatgatttatygattatagttggtttttagttagatttttttgtggagtgggaattagaatattgatttaaatyggattttygttaaygttaggagatagtttttttggttggtgtttgtttttaagggtgaattaaggagaatggtttttaggttgggtttgagtyggaggaagaygttyggatttgggaaggaggttgatgyggttttattttttagttatttttgagtataggtt

SEQ ID NO: 61 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 12: mod_base = OTHER; note = uracil
  modified_base 22: mod_base = OTHER; note = uracil
  modified_base 31: mod_base = OTHER; note = uracil
  modified_base 36: mod_base = OTHER; note = uracil
  modified_base 60: mod_base = OTHER; note = uracil
  modified_base 62: mod_base = OTHER; note = uracil
  modified_base 69: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 87: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 118: mod_base = OTHER; note = uracil
  modified_base 119: mod_base = OTHER; note = uracil
  modified_base 128: mod_base = OTHER; note = uracil
  modified_base 130: mod_base = OTHER; note = uracil
  modified_base 135: mod_base = OTHER; note = uracil
  modified_base 142: mod_base = OTHER; note = uracil
  modified_base 143: mod_base = OTHER; note = uracil
  modified_base 154: mod_base = OTHER; note = uracil
  modified_base 160: mod_base = OTHER; note = uracil
  modified_base 161: mod_base = OTHER; note = uracil
  modified_base 167: mod_base = OTHER; note = uracil
  modified_base 172: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 205: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 232: mod_base = OTHER; note = uracil
  modified_base 233: mod_base = OTHER; note = uracil
  modified_base 240: mod_base = OTHER; note = uracil
  modified_base 242: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 266: mod_base = OTHER; note = uracil
  modified_base 268: mod_base = OTHER; note = uracil
  modified_base 272: mod_base = OTHER; note = uracil
  modified_base 274: mod_base = OTHER; note = uracil
  modified_base 278: mod_base = OTHER; note = uracil
  modified_base 288: mod_base = OTHER; note = uracil
  modified_base 289: mod_base = OTHER; note = uracil
  modified_base 295: mod_base = OTHER; note = uracil
gattttaggatttgaatggtttttggagttttttgtagatgaggtaatgttttggttaatttataggttagatttgttgtttttagttaatttgttygggaggtttttaayggaaggtttgtgttagtataaattatattttttgatgaygagtagagattttgatttggttttaaagaaygygttttttaatttattttgggatttttttgaattagtyggttatatatattagggtttttagaggatttttttttttttttttttttgtttttttttgggttttttttattattaatt

SEQ ID NO: 62 - DNA, 300 bp, synthetic construct
  misc_feature 1..300: note = Synthetic polynucleotide
  source 1..300: mol_type = other DNA
  modified_base 18: mod_base = OTHER; note = uracil
  modified_base 19: mod_base = OTHER; note = uracil
  modified_base 20: mod_base = OTHER; note = uracil
  modified_base 30: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 78: mod_base = OTHER; note = uracil
  modified_base 82: mod_base = OTHER; note = uracil
  modified_base 88: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 122: mod_base = OTHER; note = uracil
  modified_base 130: mod_base = OTHER; note = uracil
  modified_base 131: mod_base = OTHER; note = uracil
  modified_base 136: mod_base = OTHER; note = uracil
  modified_base 142: mod_base = OTHER; note = uracil
  modified_base 144: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 173: mod_base = OTHER; note = uracil
  modified_base 177: mod_base = OTHER; note = uracil
  modified_base 179: mod_base = OTHER; note = uracil
  modified_base 183: mod_base = OTHER; note = uracil
  modified_base 184: mod_base = OTHER; note = uracil
  modified_base 187: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 214: mod_base = OTHER; note = uracil
  modified_base 221: mod_base = OTHER; note = uracil
  modified_base 224: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 245: mod_base = OTHER; note = uracil
  modified_base 246: mod_base = OTHER; note = uracil
  modified_base 251: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 265: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 281: mod_base = OTHER; note = uracil
  modified_base 282: mod_base = OTHER; note = uracil
  modified_base 286: mod_base = OTHER; note = uracil
  modified_base 291: mod_base = OTHER; note = uracil
  modified_base 292: mod_base = OTHER; note = uracil
  modified_base 299: mod_base = OTHER; note = uracil
  modified_base 300: mod_base = OTHER; note = uracil
attagtaataggaaaaatttagaaagagatagagagaaaggggggaaaaaattttttgagaattttggtatatgtggtyggttaatttaaaaaagttttagggtaagttggaaaaygygttttttaagattagattaaggtttttgttygttattaggaaatatgatttgtgttaatataggtttttygttaaaaatttttygggtaagttagttaaggatagtaggtttgatttatgagttaattaaaatattattttatttgtaaagaattttaagaattatttagattttgaggttt

SEQ ID NO: 63 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 19: mod_base = OTHER; note = uracil
  modified_base 21: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 42: mod_base = OTHER; note = uracil
  modified_base 44: mod_base = OTHER; note = uracil
  modified_base 47: mod_base = OTHER; note = uracil
  modified_base 54: mod_base = OTHER; note = uracil
  modified_base 56: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 69: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 95: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 112: mod_base = OTHER; note = uracil
  modified_base 124: mod_base = OTHER; note = uracil
  modified_base 127: mod_base = OTHER; note = uracil
  modified_base 129: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 147: mod_base = OTHER; note = uracil
  modified_base 153: mod_base = OTHER; note = uracil
  modified_base 162: mod_base = OTHER; note = uracil
  modified_base 168: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 185: mod_base = OTHER; note = uracil
  modified_base 187: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 209: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 221: mod_base = OTHER; note = uracil
  modified_base 224: mod_base = OTHER; note = uracil
  modified_base 232: mod_base = OTHER; note = uracil
  modified_base 238: mod_base = OTHER; note = uracil
  modified_base 241: mod_base = OTHER; note = uracil
  modified_base 244: mod_base = OTHER; note = uracil
  modified_base 250: mod_base = OTHER; note = uracil
  modified_base 253: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 270: mod_base = OTHER; note = uracil
  modified_base 271: mod_base = OTHER; note = uracil
  modified_base 277: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 298: mod_base = OTHER; note = uracil
gtttggaatttyggygattttttgtttttttattaagggaattttgtttgtaatattttaagttttagttgaaaagtggttttttgggtgaagttttatttgtgtatttatttgagggtgagttagttttgtttttttggtttttatygyggttgttatagtatttatyggagttttatagtgatttatttgtttattattttttygataaattttttagtttttgaagggtagagatagtattataattattttttataattttygtgtttagtgttatttttaatttttagtaagtat

SEQ ID NO: 64 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 8: mod_base = OTHER; note = uracil
  modified_base 25: mod_base = OTHER; note = uracil
  modified_base 27: mod_base = OTHER; note = uracil
  modified_base 32: mod_base = OTHER; note = uracil
  modified_base 61: mod_base = OTHER; note = uracil
  modified_base 65: mod_base = OTHER; note = uracil
  modified_base 67: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 81: mod_base = OTHER; note = uracil
  modified_base 109: mod_base = OTHER; note = uracil
  modified_base 118: mod_base = OTHER; note = uracil
  modified_base 120: mod_base = OTHER; note = uracil
  modified_base 128: mod_base = OTHER; note = uracil
  modified_base 130: mod_base = OTHER; note = uracil
  modified_base 140: mod_base = OTHER; note = uracil
  modified_base 146: mod_base = OTHER; note = uracil
  modified_base 149: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 175: mod_base = OTHER; note = uracil
  modified_base 179: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 197: mod_base = OTHER; note = uracil
  modified_base 199: mod_base = OTHER; note = uracil
  modified_base 208: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 230: mod_base = OTHER; note = uracil
  modified_base 233: mod_base = OTHER; note = uracil
  modified_base 239: mod_base = OTHER; note = uracil
  modified_base 251: mod_base = OTHER; note = uracil
  modified_base 255: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 277: mod_base = OTHER; note = uracil
  modified_base 287: mod_base = OTHER; note = uracil
  modified_base 295: mod_base = OTHER; note = uracil
  modified_base 296: mod_base = OTHER; note = uracil
  modified_base 300: mod_base = OTHER; note = uracil
atgtttattagggattgggagtagtattaggtaygggagttataaaagatgattatgatgttgtttttgttttttagaagttggaaggtttgtygggagggtgatggataaatgagttattgtgggatttyggtaaatgttataatagtygyggtgagagttaggggagtagagttgatttatttttaggtgggtgtataggtgagattttatttaggagattattttttagttgaggtttaaagtgttataagtagagtttttttggtggagaaataagagatygtyggggttttaggt

SEQ ID NO: 65 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 21: mod_base = OTHER; note = uracil
  modified_base 29: mod_base = OTHER; note = uracil
  modified_base 33: mod_base = OTHER; note = uracil
  modified_base 42: mod_base = OTHER; note = uracil
  modified_base 46: mod_base = OTHER; note = uracil
  modified_base 55: mod_base = OTHER; note = uracil
  modified_base 59: mod_base = OTHER; note = uracil
  modified_base 65: mod_base = OTHER; note = uracil
  modified_base 67: mod_base = OTHER; note = uracil
  modified_base 69: mod_base = OTHER; note = uracil
  modified_base 71: mod_base = OTHER; note = uracil
  modified_base 75: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 91: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 118: mod_base = OTHER; note = uracil
  modified_base 119: mod_base = OTHER; note = uracil
  modified_base 135: mod_base = OTHER; note = uracil
  modified_base 140: mod_base = OTHER; note = uracil
  modified_base 143: mod_base = OTHER; note = uracil
  modified_base 155: mod_base = OTHER; note = uracil
  modified_base 156: mod_base = OTHER; note = uracil
  modified_base 162: mod_base = OTHER; note = uracil
  modified_base 164: mod_base = OTHER; note = uracil
  modified_base 173: mod_base = OTHER; note = uracil
  modified_base 174: mod_base = OTHER; note = uracil
  modified_base 179: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 219: mod_base = OTHER; note = uracil
  modified_base 220: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 247: mod_base = OTHER; note = uracil
  modified_base 251: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 274: mod_base = OTHER; note = uracil
  modified_base 279: mod_base = OTHER; note = uracil
  modified_base 282: mod_base = OTHER; note = uracil
  modified_base 296: mod_base = OTHER; note = uracil
  modified_base 297: mod_base = OTHER; note = uracil
aatttttttttygggatagttaaygaggtttttaatttaaatttgtatttgaagtttgtagagatttatattgatttatttaggttttaatatatagtagttgtttttatggttgygttaggtagtgaaggatatagggtagtaggaaaygagtttyggtttttaggtggatttygtgtttttatttttgttagagtttaggttttgagggtatagggttaaattgttatagagttttagagaaatttgtttttttygttttttattttaagattgagttgttggaggaaagaggttagg

SEQ ID NO: 66 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 23: mod_base = OTHER; note = uracil
  modified_base 25: mod_base = OTHER; note = uracil
  modified_base 29: mod_base = OTHER; note = uracil
  modified_base 52: mod_base = OTHER; note = uracil
  modified_base 59: mod_base = OTHER; note = uracil
  modified_base 61: mod_base = OTHER; note = uracil
  modified_base 67: mod_base = OTHER; note = uracil
  modified_base 69: mod_base = OTHER; note = uracil
  modified_base 75: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 105: mod_base = OTHER; note = uracil
  modified_base 107: mod_base = OTHER; note = uracil
  modified_base 111: mod_base = OTHER; note = uracil
  modified_base 123: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 170: mod_base = OTHER; note = uracil
  modified_base 171: mod_base = OTHER; note = uracil
  modified_base 174: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 198: mod_base = OTHER; note = uracil
  modified_base 201: mod_base = OTHER; note = uracil
  modified_base 204: mod_base = OTHER; note = uracil
  modified_base 217: mod_base = OTHER; note = uracil
  modified_base 218: mod_base = OTHER; note = uracil
  modified_base 228: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 247: mod_base = OTHER; note = uracil
  modified_base 250: mod_base = OTHER; note = uracil
  modified_base 256: mod_base = OTHER; note = uracil
  modified_base 273: mod_base = OTHER; note = uracil
  modified_base 274: mod_base = OTHER; note = uracil
  modified_base 282: mod_base = OTHER; note = uracil
  modified_base 286: mod_base = OTHER; note = uracil
  modified_base 287: mod_base = OTHER; note = uracil
tttggttttttttttttagtagtttagttttagggtgggggaygggagagatagatttttttggagttttgtggtaatttggttttatgtttttagggtttgggttttaatagaggtggaagtaygggatttatttgagaatygggattygttttttgttgttttgtattttttattatttggygtaattatggagatagttgttgtgtgttagggtttgggtaagttagtgtgagtttttgtaagttttaaatgtaagtttaaattgaaagtttygttgattatttyggggaagggatt

SEQ ID NO: 67 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 30: mod_base = OTHER; note = uracil
  modified_base 36: mod_base = OTHER; note = uracil
  modified_base 44: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 56: mod_base = OTHER; note = uracil
  modified_base 63: mod_base = OTHER; note = uracil
  modified_base 70: mod_base = OTHER; note = uracil
  modified_base 72: mod_base = OTHER; note = uracil
  modified_base 81: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 97: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 143: mod_base = OTHER; note = uracil
  modified_base 169: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 194: mod_base = OTHER; note = uracil
  modified_base 205: mod_base = OTHER; note = uracil
  modified_base 213: mod_base = OTHER; note = uracil
  modified_base 215: mod_base = OTHER; note = uracil
  modified_base 221: mod_base = OTHER; note = uracil
  modified_base 226: mod_base = OTHER; note = uracil
  modified_base 227: mod_base = OTHER; note = uracil
  modified_base 233: mod_base = OTHER; note = uracil
  modified_base 234: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 251: mod_base = OTHER; note = uracil
  modified_base 258: mod_base = OTHER; note = uracil
  modified_base 259: mod_base = OTHER; note = uracil
  modified_base 266: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 282: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 299: mod_base = OTHER; note = uracil
aggaatgtttattgaaggagtgaatgaaattattgtattagattaagtttaggtgtagaggattggttttatatagaaagtatygattttgttttatagaattttgattttagttttttagtagataattttggtgtgaagatagaggggyggggaggaaggtaggggttgatattttttagttttttttaggtyggtggggagttgaatagtttagtgatttgtttaggagttygaggtaaattatagattaagagttaagagttatgatttattatttgtatttttttagttatgata

SEQ ID NO: 68 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 9: mod_base = OTHER; note = uracil
  modified_base 20: mod_base = OTHER; note = uracil
  modified_base 32: mod_base = OTHER; note = uracil
  modified_base 37: mod_base = OTHER; note = uracil
  modified_base 39: mod_base = OTHER; note = uracil
  modified_base 44: mod_base = OTHER; note = uracil
  modified_base 46: mod_base = OTHER; note = uracil
  modified_base 52: mod_base = OTHER; note = uracil
  modified_base 62: mod_base = OTHER; note = uracil
  modified_base 63: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 77: mod_base = OTHER; note = uracil
  modified_base 82: mod_base = OTHER; note = uracil
  modified_base 84: mod_base = OTHER; note = uracil
  modified_base 89: mod_base = OTHER; note = uracil
  modified_base 94: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 108: mod_base = OTHER; note = uracil
  modified_base 109: mod_base = OTHER; note = uracil
  modified_base 119: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 177: mod_base = OTHER; note = uracil
  modified_base 180: mod_base = OTHER; note = uracil
  modified_base 188: mod_base = OTHER; note = uracil
  modified_base 195: mod_base = OTHER; note = uracil
  modified_base 202: mod_base = OTHER; note = uracil
  modified_base 210: mod_base = OTHER; note = uracil
  modified_base 221: mod_base = OTHER; note = uracil
  modified_base 225: mod_base = OTHER; note = uracil
  modified_base 235: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 254: mod_base = OTHER; note = uracil
  modified_base 260: mod_base = OTHER; note = uracil
  modified_base 266: mod_base = OTHER; note = uracil
  modified_base 275: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 294: mod_base = OTHER; note = uracil
  modified_base 298: mod_base = OTHER; note = uracil
  modified_base 299: mod_base = OTHER; note = uracil
tgttatggttggagaaatgtaagtagtgaattatgatttttggtttttagtttgtggtttatttygggtttttggataagttattgagttatttagttttttatyggtttgggaggggttgggaaatgttagtttttattttttttttygtttttttgtttttatattagggttgtttgttggaaaattggagttagggttttgtagggtaaaatygatgttttttatgtgaaattagttttttgtatttgggtttgatttaatgtaatagttttatttatttttttagtaaatattttt

SEQ ID NO: 69 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 17: mod_base = OTHER; note = uracil
  modified_base 19: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 34: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 79: mod_base = OTHER; note = uracil
  modified_base 80: mod_base = OTHER; note = uracil
  modified_base 89: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 138: mod_base = OTHER; note = uracil
  modified_base 147: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 170: mod_base = OTHER; note = uracil
  modified_base 172: mod_base = OTHER; note = uracil
  modified_base 177: mod_base = OTHER; note = uracil
  modified_base 178: mod_base = OTHER; note = uracil
  modified_base 188: mod_base = OTHER; note = uracil
  modified_base 191: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 233: mod_base = OTHER; note = uracil
  modified_base 249: mod_base = OTHER; note = uracil
  modified_base 253: mod_base = OTHER; note = uracil
  modified_base 255: mod_base = OTHER; note = uracil
  modified_base 258: mod_base = OTHER; note = uracil
  modified_base 260: mod_base = OTHER; note = uracil
  modified_base 262: mod_base = OTHER; note = uracil
  modified_base 265: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 285: mod_base = OTHER; note = uracil
  modified_base 294: mod_base = OTHER; note = uracil
  modified_base 300: mod_base = OTHER; note = uracil
gttgggattatatatgtatattattatgttyggttaatttttatatttttggtagagataggggttttattatgttggttagggtggttttgaatttttgattttaggtgatttatttattttggttttttagagtgttgggattataggygtgagttattgtattyggtataaagttattttaaaatagttttttttttttttttgaaatagttttgttttgtagtttaggttggagtgtagtggtataattttagtttattgtaatttttatttttygggtttaagtgatttttgtgt

SEQ ID NO: 70 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 11: mod_base = OTHER; note = uracil
  modified_base 13: mod_base = OTHER; note = uracil
  modified_base 19: mod_base = OTHER; note = uracil
  modified_base 20: mod_base = OTHER; note = uracil
  modified_base 37: mod_base = OTHER; note = uracil
  modified_base 44: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 75: mod_base = OTHER; note = uracil
  modified_base 78: mod_base = OTHER; note = uracil
  modified_base 83: mod_base = OTHER; note = uracil
  modified_base 88: mod_base = OTHER; note = uracil
  modified_base 94: mod_base = OTHER; note = uracil
  modified_base 111: mod_base = OTHER; note = uracil
  modified_base 125: mod_base = OTHER; note = uracil
  modified_base 132: mod_base = OTHER; note = uracil
  modified_base 139: mod_base = OTHER; note = uracil
  modified_base 145: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 166: mod_base = OTHER; note = uracil
  modified_base 168: mod_base = OTHER; note = uracil
  modified_base 176: mod_base = OTHER; note = uracil
  modified_base 177: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 201: mod_base = OTHER; note = uracil
  modified_base 209: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 268: mod_base = OTHER; note = uracil
  modified_base 273: mod_base = OTHER; note = uracil
  modified_base 285: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gtataagaattatttgaattyggaaggtggaggttgtagtgagttgagattgtattattatattttagtttgggttatagggtaaggttgttttaaaaaaaaaaaaaaagttgttttaaaatggttttgtgtygggtgtagtggtttaygtttgtaattttagtattttgggaggttaaggtgggtggattatttgaggttaggggtttaagattattttggttaatatggtggaatttttatttttattaaaaatataaaaattagtygggtatggtggtgtgtatatataattttagt

SEQ ID NO: 71 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 9: mod_base = OTHER; note = uracil
  modified_base 10: mod_base = OTHER; note = uracil
  modified_base 12: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 25: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 61: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 86: mod_base = OTHER; note = uracil
  modified_base 91: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 131: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 152: mod_base = OTHER; note = uracil
  modified_base 154: mod_base = OTHER; note = uracil
  modified_base 156: mod_base = OTHER; note = uracil
  modified_base 162: mod_base = OTHER; note = uracil
  modified_base 164: mod_base = OTHER; note = uracil
  modified_base 177: mod_base = OTHER; note = uracil
  modified_base 182: mod_base = OTHER; note = uracil
  modified_base 186: mod_base = OTHER; note = uracil
  modified_base 188: mod_base = OTHER; note = uracil
  modified_base 190: mod_base = OTHER; note = uracil
  modified_base 198: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 221: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 254: mod_base = OTHER; note = uracil
  modified_base 260: mod_base = OTHER; note = uracil
  modified_base 261: mod_base = OTHER; note = uracil
  modified_base 270: mod_base = OTHER; note = uracil
  modified_base 274: mod_base = OTHER; note = uracil
  modified_base 280: mod_base = OTHER; note = uracil
  modified_base 281: mod_base = OTHER; note = uracil
  modified_base 286: mod_base = OTHER; note = uracil
  modified_base 287: mod_base = OTHER; note = uracil
  modified_base 291: mod_base = OTHER; note = uracil
  modified_base 292: mod_base = OTHER; note = uracil
  modified_base 296: mod_base = OTHER; note = uracil
  modified_base 299: mod_base = OTHER; note = uracil
aataaatgttataggttttaattgtaggttttaaggagttgagattttatattggggttgttggaggtagaagtttttttatttttaggattyggatttgttttttttttaygyggtttygtttagttagttatattttggttatagagygtttataaaggtttagtgtgtgtatgtygggttgatttatagtggttttgggtttaggygaggatttttttagaggggyggaaggggtttttttttttttggttattttttatggggagtagttagtaattaggattatgttagatttta

SEQ ID NO: 72 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 17: mod_base = OTHER; note = uracil
  modified_base 18: mod_base = OTHER; note = uracil
  modified_base 25: mod_base = OTHER; note = uracil
  modified_base 29: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 49: mod_base = OTHER; note = uracil
  modified_base 50: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 70: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 125: mod_base = OTHER; note = uracil
  modified_base 129: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 140: mod_base = OTHER; note = uracil
  modified_base 141: mod_base = OTHER; note = uracil
  modified_base 152: mod_base = OTHER; note = uracil
  modified_base 154: mod_base = OTHER; note = uracil
  modified_base 160: mod_base = OTHER; note = uracil
  modified_base 161: mod_base = OTHER; note = uracil
  modified_base 171: mod_base = OTHER; note = uracil
  modified_base 175: mod_base = OTHER; note = uracil
  modified_base 185: mod_base = OTHER; note = uracil
  modified_base 201: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 228: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 258: mod_base = OTHER; note = uracil
  modified_base 260: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 286: mod_base = OTHER; note = uracil
  modified_base 287: mod_base = OTHER; note = uracil
  modified_base 293: mod_base = OTHER; note = uracil
tgaagtttggtatggttttggttattgattgttttttatggaaaatggttaggagggagagggtttttttygtttttttgagaaggttttygtttgggtttagaattattgtgagttagttyggtatatatatattgagtttttgtgagygttttgtggttagggtgtagttggttgggygggatygygtgggggaagggtaggttygggttttgaaagtgggaaggtttttgtttttagtaattttagtatggaattttaattttttggagtttgtaattagggtttgtggtatttgtt

SEQ ID NO: 73 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 10: mod_base = OTHER; note = uracil
  modified_base 13: mod_base = OTHER; note = uracil
  modified_base 16: mod_base = OTHER; note = uracil
  modified_base 21: mod_base = OTHER; note = uracil
  modified_base 22: mod_base = OTHER; note = uracil
  modified_base 27: mod_base = OTHER; note = uracil
  modified_base 35: mod_base = OTHER; note = uracil
  modified_base 38: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 76: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 108: mod_base = OTHER; note = uracil
  modified_base 118: mod_base = OTHER; note = uracil
  modified_base 124: mod_base = OTHER; note = uracil
  modified_base 130: mod_base = OTHER; note = uracil
  modified_base 133: mod_base = OTHER; note = uracil
  modified_base 135: mod_base = OTHER; note = uracil
  modified_base 141: mod_base = OTHER; note = uracil
  modified_base 143: mod_base = OTHER; note = uracil
  modified_base 152: mod_base = OTHER; note = uracil
  modified_base 158: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 171: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 190: mod_base = OTHER; note = uracil
  modified_base 193: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 215: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 245: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 276: mod_base = OTHER; note = uracil
  modified_base 278: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 292: mod_base = OTHER; note = uracil
  modified_base 294: mod_base = OTHER; note = uracil
  modified_base 298: mod_base = OTHER; note = uracil
gtagtgttataatattaatgttaaggtygtggggtagttgatggtttgggtttttaattttttagttaggtgtttttgtaggtttatattttgtttattggttaaatttttaaataattttgattygggttatttttatgtttaaagaygttaggggtttttttaaatttttttattttgttagaaagttttttatagtayggtttttatttagtttttaygtttgattttttatygtattttgtttataatttgttattagtgaatttttgttgtttyggttttatattttttatgttg

SEQ ID NO: 74 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 19: mod_base = OTHER; note = uracil
  modified_base 25: mod_base = OTHER; note = uracil
  modified_base 28: mod_base = OTHER; note = uracil
  modified_base 36: mod_base = OTHER; note = uracil
  modified_base 38: mod_base = OTHER; note = uracil
  modified_base 45: mod_base = OTHER; note = uracil
  modified_base 56: mod_base = OTHER; note = uracil
  modified_base 74: mod_base = OTHER; note = uracil
  modified_base 86: mod_base = OTHER; note = uracil
  modified_base 97: mod_base = OTHER; note = uracil
  modified_base 102: mod_base = OTHER; note = uracil
  modified_base 112: mod_base = OTHER; note = uracil
  modified_base 116: mod_base = OTHER; note = uracil
  modified_base 120: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 153: mod_base = OTHER; note = uracil
  modified_base 160: mod_base = OTHER; note = uracil
  modified_base 171: mod_base = OTHER; note = uracil
  modified_base 172: mod_base = OTHER; note = uracil
  modified_base 178: mod_base = OTHER; note = uracil
  modified_base 199: mod_base = OTHER; note = uracil
  modified_base 200: mod_base = OTHER; note = uracil
  modified_base 207: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 235: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 257: mod_base = OTHER; note = uracil
  modified_base 260: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 274: mod_base = OTHER; note = uracil
  modified_base 275: mod_base = OTHER; note = uracil
  modified_base 280: mod_base = OTHER; note = uracil
  modified_base 294: mod_base = OTHER; note = uracil
  modified_base 296: mod_base = OTHER; note = uracil
  modified_base 299: mod_base = OTHER; note = uracil
  modified_base 300: mod_base = OTHER; note = uracil
agtatgagaagtgtggagtyggagtagtaggggtttattagtggtaggttatgagtaggatgygatggaagattaggygtgaaagttaagtggaggtygtattatagaagattttttggtagggtaaagagatttgggagagtttttgaygtttttgagtataagagtagttygagttaaagttatttaaaggtttggttagtgggtaagatgtgggtttgtagaagtatttggttgggaagttgggagtttaaattattagttgttttayggttttggtattgatgttgtagtattgtt

SEQ ID NO: 75 - DNA, 300 bp, synthetic construct
  misc_feature 1..300: note = Synthetic polynucleotide
  source 1..300: mol_type = other DNA
  modified_base 27: mod_base = OTHER; note = uracil
  modified_base 41: mod_base = OTHER; note = uracil
  modified_base 43: mod_base = OTHER; note = uracil
  modified_base 46: mod_base = OTHER; note = uracil
  modified_base 55: mod_base = OTHER; note = uracil
  modified_base 61: mod_base = OTHER; note = uracil
  modified_base 84: mod_base = OTHER; note = uracil
  modified_base 89: mod_base = OTHER; note = uracil
  modified_base 110: mod_base = OTHER; note = uracil
  modified_base 111: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 157: mod_base = OTHER; note = uracil
  modified_base 166: mod_base = OTHER; note = uracil
  modified_base 167: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 180: mod_base = OTHER; note = uracil
  modified_base 193: mod_base = OTHER; note = uracil
  modified_base 203: mod_base = OTHER; note = uracil
  modified_base 204: mod_base = OTHER; note = uracil
  modified_base 209: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 231: mod_base = OTHER; note = uracil
  modified_base 233: mod_base = OTHER; note = uracil
  modified_base 235: mod_base = OTHER; note = uracil
  modified_base 244: mod_base = OTHER; note = uracil
  modified_base 250: mod_base = OTHER; note = uracil
  modified_base 257: mod_base = OTHER; note = uracil
  modified_base 258: mod_base = OTHER; note = uracil
  modified_base 275: mod_base = OTHER; note = uracil
  modified_base 277: mod_base = OTHER; note = uracil
  modified_base 287: mod_base = OTHER; note = uracil
  modified_base 288: mod_base = OTHER; note = uracil
  modified_base 297: mod_base = OTHER; note = uracil
aggagggaygtggaagtygtgggtggtagagaaaagtgtgtatygttgggaggtttattttaagaataggttgggatgagaaatatgtttgggygaggggggtgggaggttyggtgttatttgtggatggatttatagttttgtaattgygtgttgtaaagtttgttyggtttygtatttattttgaaggtttttggygatgtttygatttttygttttaaagaagtgagtttttataaggtttagaggtygggagttaaagygggagtgaagattttygaggggtttaaatgaagtaga

SEQ ID NO: 76 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 8: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 28: mod_base = OTHER; note = uracil
  modified_base 31: mod_base = OTHER; note = uracil
  modified_base 33: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 53: mod_base = OTHER; note = uracil
  modified_base 55: mod_base = OTHER; note = uracil
  modified_base 60: mod_base = OTHER; note = uracil
  modified_base 61: mod_base = OTHER; note = uracil
  modified_base 71: mod_base = OTHER; note = uracil
  modified_base 73: mod_base = OTHER; note = uracil
  modified_base 75: mod_base = OTHER; note = uracil
  modified_base 78: mod_base = OTHER; note = uracil
  modified_base 99: mod_base = OTHER; note = uracil
  modified_base 104: mod_base = OTHER; note = uracil
  modified_base 105: mod_base = OTHER; note = uracil
  modified_base 111: mod_base = OTHER; note = uracil
  modified_base 112: mod_base = OTHER; note = uracil
  modified_base 115: mod_base = OTHER; note = uracil
  modified_base 131: mod_base = OTHER; note = uracil
  modified_base 136: mod_base = OTHER; note = uracil
  modified_base 140: mod_base = OTHER; note = uracil
  modified_base 145: mod_base = OTHER; note = uracil
  modified_base 148: mod_base = OTHER; note = uracil
  modified_base 152: mod_base = OTHER; note = uracil
  modified_base 158: mod_base = OTHER; note = uracil
  modified_base 163: mod_base = OTHER; note = uracil
  modified_base 171: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 185: mod_base = OTHER; note = uracil
  modified_base 187: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 221: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 237: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 261: mod_base = OTHER; note = uracil
  modified_base 263: mod_base = OTHER; note = uracil
  modified_base 265: mod_base = OTHER; note = uracil
  modified_base 270: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 285: mod_base = OTHER; note = uracil
  modified_base 288: mod_base = OTHER; note = uracil
  modified_base 289: mod_base = OTHER; note = uracil
  modified_base 294: mod_base = OTHER; note = uracil
  modified_base 295: mod_base = OTHER; note = uracil
  modified_base 296: mod_base = OTHER; note = uracil
  modified_base 298: mod_base = OTHER; note = uracil
  modified_base 299: mod_base = OTHER; note = uracil
tttgttttatttggatttttygagagtttttattttygttttggttttyggtttttgaattttatgagagtttatttttttgaggygaaaagtygaggtatygttaagaatttttaaaatgaatgyggggtygggtaaattttgtaataygtaattgtagggttgtggatttatttataggtgatatygggttttttatttttttygtttagatatgttttttattttaatttatttttgaaatagattttttagyggtgtatatttttttttgttatttaygatttttaygtttttttt

SEQ ID NO: 77 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 10: mod_base = OTHER; note = uracil
  modified_base 11: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 31: mod_base = OTHER; note = uracil
  modified_base 32: mod_base = OTHER; note = uracil
  modified_base 37: mod_base = OTHER; note = uracil
  modified_base 47: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 88: mod_base = OTHER; note = uracil
  modified_base 93: mod_base = OTHER; note = uracil
  modified_base 95: mod_base = OTHER; note = uracil
  modified_base 99: mod_base = OTHER; note = uracil
  modified_base 101: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 182: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 226: mod_base = OTHER; note = uracil
  modified_base 244: mod_base = OTHER; note = uracil
  modified_base 250: mod_base = OTHER; note = uracil
  modified_base 251: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 274: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 298: mod_base = OTHER; note = uracil
  modified_base 300: mod_base = OTHER; note = uracil
tttttttgatttggygagttttttttttttttattttattttattgttttttattgttttttttyggttttttttttttttttaggttttttttttagtttagtttggagtttatattttttttattttttttattttttttttttttygttttaggattatttttgggatttattttgagttgagtttatagttagttagttaygaaatagaggtgygygggggtagggtggtatggagattttgyggtttttgatttgatatttttyggagttatygttataggtttgtttattttat

SEQ ID NO: 78 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 14: mod_base = OTHER; note = uracil
  modified_base 15: mod_base = OTHER; note = uracil
  modified_base 27: mod_base = OTHER; note = uracil
  modified_base 29: mod_base = OTHER; note = uracil
  modified_base 40: mod_base = OTHER; note = uracil
  modified_base 45: mod_base = OTHER; note = uracil
  modified_base 51: mod_base = OTHER; note = uracil
  modified_base 54: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 99: mod_base = OTHER; note = uracil
  modified_base 103: mod_base = OTHER; note = uracil
  modified_base 107: mod_base = OTHER; note = uracil
  modified_base 114: mod_base = OTHER; note = uracil
  modified_base 116: mod_base = OTHER; note = uracil
  modified_base 119: mod_base = OTHER; note = uracil
  modified_base 121: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 143: mod_base = OTHER; note = uracil
  modified_base 144: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 202: mod_base = OTHER; note = uracil
  modified_base 214: mod_base = OTHER; note = uracil
  modified_base 215: mod_base = OTHER; note = uracil
  modified_base 233: mod_base = OTHER; note = uracil
  modified_base 244: mod_base = OTHER; note = uracil
  modified_base 254: mod_base = OTHER; note = uracil
  modified_base 282: mod_base = OTHER; note = uracil
  modified_base 286: mod_base = OTHER; note = uracil
  modified_base 287: mod_base = OTHER; note = uracil
  modified_base 292: mod_base = OTHER; note = uracil
  modified_base 300: mod_base = OTHER; note = uracil
tgaaatgggtaggtttgtggyggtagtttygggaggtgttaaattaaaggtygtagaatttttatattattttgttttygygtatttttatttygtggttggttggttgtaggtttagtttaggatgggttttagggataattttggggyggaggaaggaggaggtgaaaagggtggaaaggatgtgagttttaaattgagttagagaaaagatttaggaggggagaagaggtyggagggaaataataaaaagtaataaaatgaaatggaaagggaagggattygttaggttaaaaaggt

SEQ ID NO: 79 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 14: mod_base = OTHER; note = uracil
  modified_base 16: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 51: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 79: mod_base = OTHER; note = uracil
  modified_base 80: mod_base = OTHER; note = uracil
  modified_base 85: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 105: mod_base = OTHER; note = uracil
  modified_base 106: mod_base = OTHER; note = uracil
  modified_base 129: mod_base = OTHER; note = uracil
  modified_base 147: mod_base = OTHER; note = uracil
  modified_base 153: mod_base = OTHER; note = uracil
  modified_base 154: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 177: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 207: mod_base = OTHER; note = uracil
  modified_base 219: mod_base = OTHER; note = uracil
  modified_base 225: mod_base = OTHER; note = uracil
  modified_base 228: mod_base = OTHER; note = uracil
  modified_base 250: mod_base = OTHER; note = uracil
  modified_base 252: mod_base = OTHER; note = uracil
  modified_base 254: mod_base = OTHER; note = uracil
  modified_base 260: mod_base = OTHER; note = uracil
  modified_base 261: mod_base = OTHER; note = uracil
  modified_base 266: mod_base = OTHER; note = uracil
  modified_base 278: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 296: mod_base = OTHER; note = uracil
  modified_base 299: mod_base = OTHER; note = uracil
gtttagtttggagtttatattttttttattttttttattttttttttttttygttttaggattatttttgggatttattttgagttgagtttatagttagttagttaygaaatagaggtgygygggggtagggtggtatggagattttgyggtttttgatttgatatttttyggagttatygttataggtttgtttattttatttgtygggaagataattttggtttttggtggtgggtgggtgattgatttttaaaatttaaagtattggttttttttgggttattttttatgattgtt

SEQ ID NO: 80 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 30: mod_base = OTHER; note = uracil
  modified_base 31: mod_base = OTHER; note = uracil
  modified_base 36: mod_base = OTHER; note = uracil
  modified_base 53: mod_base = OTHER; note = uracil
  modified_base 57: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 77: mod_base = OTHER; note = uracil
  modified_base 78: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 125: mod_base = OTHER; note = uracil
  modified_base 127: mod_base = OTHER; note = uracil
  modified_base 138: mod_base = OTHER; note = uracil
  modified_base 143: mod_base = OTHER; note = uracil
  modified_base 149: mod_base = OTHER; note = uracil
  modified_base 152: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 197: mod_base = OTHER; note = uracil
  modified_base 201: mod_base = OTHER; note = uracil
  modified_base 205: mod_base = OTHER; note = uracil
  modified_base 212: mod_base = OTHER; note = uracil
  modified_base 214: mod_base = OTHER; note = uracil
  modified_base 217: mod_base = OTHER; note = uracil
  modified_base 219: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 241: mod_base = OTHER; note = uracil
  modified_base 242: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 295: mod_base = OTHER; note = uracil
  modified_base 300: mod_base = OTHER; note = uracil
agtagttataggaagtaatttagaaaaaattaatgttttggattttgagagttaattatttatttattattagaagttaaagttattttttyggtaggtgaaatgggtaggtttgtggyggtagtttygggaggtgttaaattaaaggtygtagaatttttatattattttgttttygygtatttttatttygtggttggttggttgtaggtttagtttaggatgggttttagggataattttggggyggaggaaggaggaggtgaaaagggtggaaaggatgtgagttttaaattgagt

SEQ ID NO: 81 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 9: mod_base = OTHER; note = uracil
  modified_base 12: mod_base = OTHER; note = uracil
  modified_base 15: mod_base = OTHER; note = uracil
  modified_base 18: mod_base = OTHER; note = uracil
  modified_base 19: mod_base = OTHER; note = uracil
  modified_base 23: mod_base = OTHER; note = uracil
  modified_base 25: mod_base = OTHER; note = uracil
  modified_base 47: mod_base = OTHER; note = uracil
  modified_base 48: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 60: mod_base = OTHER; note = uracil
  modified_base 61: mod_base = OTHER; note = uracil
  modified_base 66: mod_base = OTHER; note = uracil
  modified_base 69: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 86: mod_base = OTHER; note = uracil
  modified_base 91: mod_base = OTHER; note = uracil
  modified_base 114: mod_base = OTHER; note = uracil
  modified_base 116: mod_base = OTHER; note = uracil
  modified_base 133: mod_base = OTHER; note = uracil
  modified_base 134: mod_base = OTHER; note = uracil
  modified_base 139: mod_base = OTHER; note = uracil
  modified_base 143: mod_base = OTHER; note = uracil
  modified_base 148: mod_base = OTHER; note = uracil
  modified_base 157: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 198: mod_base = OTHER; note = uracil
  modified_base 204: mod_base = OTHER; note = uracil
  modified_base 211: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 250: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 280: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 296: mod_base = OTHER; note = uracil
  modified_base 299: mod_base = OTHER; note = uracil
tattttaatttttgtaattatgtatagtgatygatatttataattattttttttttttattatggtaatygggtttttygaygagtaggattgaagaaggaaygaggaataaattttgggagtggaagygygtttyggtagatagattygygggygttggggtagttaggagaagtttyggtattygtttgtgaggttyggggttgtggtttygagtttygtttygtttyggygggtttygtttttatgttygtttygttatygttttygygttttttttygttygttygtygagttgta

SEQ ID NO: 82 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 6: mod_base = OTHER; note = uracil
  modified_base 52: mod_base = OTHER; note = uracil
  modified_base 65: mod_base = OTHER; note = uracil
  modified_base 66: mod_base = OTHER; note = uracil
  modified_base 69: mod_base = OTHER; note = uracil
  modified_base 85: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 110: mod_base = OTHER; note = uracil
  modified_base 120: mod_base = OTHER; note = uracil
  modified_base 126: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 148: mod_base = OTHER; note = uracil
  modified_base 156: mod_base = OTHER; note = uracil
  modified_base 160: mod_base = OTHER; note = uracil
  modified_base 163: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 194: mod_base = OTHER; note = uracil
  modified_base 195: mod_base = OTHER; note = uracil
  modified_base 201: mod_base = OTHER; note = uracil
  modified_base 202: mod_base = OTHER; note = uracil
  modified_base 205: mod_base = OTHER; note = uracil
  modified_base 208: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 228: mod_base = OTHER; note = uracil
  modified_base 229: mod_base = OTHER; note = uracil
  modified_base 236: mod_base = OTHER; note = uracil
  modified_base 237: mod_base = OTHER; note = uracil
  modified_base 272: mod_base = OTHER; note = uracil
  modified_base 274: mod_base = OTHER; note = uracil
  modified_base 279: mod_base = OTHER; note = uracil
  modified_base 287: mod_base = OTHER; note = uracil
tgtagttyggygggygggyggagaagagygygggggygatagyggggygggtatgggagyggggttygtygaggyggggygggattygagattatagtttyggattttataagyggatgtyggggttttttttggttgttttagygttygyggatttgtttgtygaggygygtttttatttttagagtttatttttygttttttttttagttttgttygtyggaggattyggttgttatggtgaaggaaaaaggtaattataaatatygattattgtgtatggttgtagaagttggaatg

SEQ ID NO: 83 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 9: mod_base = OTHER; note = uracil
  modified_base 22: mod_base = OTHER; note = uracil
  modified_base 23: mod_base = OTHER; note = uracil
  modified_base 39: mod_base = OTHER; note = uracil
  modified_base 49: mod_base = OTHER; note = uracil
  modified_base 52: mod_base = OTHER; note = uracil
  modified_base 61: mod_base = OTHER; note = uracil
  modified_base 68: mod_base = OTHER; note = uracil
  modified_base 71: mod_base = OTHER; note = uracil
  modified_base 86: mod_base = OTHER; note = uracil
  modified_base 87: mod_base = OTHER; note = uracil
  modified_base 95: mod_base = OTHER; note = uracil
  modified_base 97: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 114: mod_base = OTHER; note = uracil
  modified_base 115: mod_base = OTHER; note = uracil
  modified_base 126: mod_base = OTHER; note = uracil
  modified_base 128: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 144: mod_base = OTHER; note = uracil
  modified_base 145: mod_base = OTHER; note = uracil
  modified_base 149: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 172: mod_base = OTHER; note = uracil
  modified_base 176: mod_base = OTHER; note = uracil
  modified_base 192: mod_base = OTHER; note = uracil
  modified_base 196: mod_base = OTHER; note = uracil
  modified_base 200: mod_base = OTHER; note = uracil
  modified_base 204: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 254: mod_base = OTHER; note = uracil
  modified_base 256: mod_base = OTHER; note = uracil
  modified_base 261: mod_base = OTHER; note = uracil
  modified_base 262: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 280: mod_base = OTHER; note = uracil
  modified_base 282: mod_base = OTHER; note = uracil
  modified_base 285: mod_base = OTHER; note = uracil
  modified_base 289: mod_base = OTHER; note = uracil
  modified_base 292: mod_base = OTHER; note = uracil
  modified_base 293: mod_base = OTHER; note = uracil
tatgatgttagtggttgaatattttagtagagaaaaattttgaataattaatyggaggtttaggagatagttgggtatttgagagtttatgagttatataagtaattttggagttaagttgtattttttgtttggttttagagttagtttygagtatatgtagttagattgtyggtagagaagatgtggagttggtattttggtttaggtttgagtaaggtygtggaagttttaggtttttgattatggttygtatagagttatgttttagttttgggttttagtaggtagttaggtgag

SEQ ID NO: 84 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 13: mod_base = OTHER; note = uracil
  modified_base 14: mod_base = OTHER; note = uracil
  modified_base 17: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 30: mod_base = OTHER; note = uracil
  modified_base 36: mod_base = OTHER; note = uracil
  modified_base 41: mod_base = OTHER; note = uracil
  modified_base 43: mod_base = OTHER; note = uracil
  modified_base 52: mod_base = OTHER; note = uracil
  modified_base 53: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 81: mod_base = OTHER; note = uracil
  modified_base 82: mod_base = OTHER; note = uracil
  modified_base 86: mod_base = OTHER; note = uracil
  modified_base 88: mod_base = OTHER; note = uracil
  modified_base 92: mod_base = OTHER; note = uracil
  modified_base 93: mod_base = OTHER; note = uracil
  modified_base 98: mod_base = OTHER; note = uracil
  modified_base 99: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 130: mod_base = OTHER; note = uracil
  modified_base 134: mod_base = OTHER; note = uracil
  modified_base 138: mod_base = OTHER; note = uracil
  modified_base 141: mod_base = OTHER; note = uracil
  modified_base 147: mod_base = OTHER; note = uracil
  modified_base 154: mod_base = OTHER; note = uracil
  modified_base 158: mod_base = OTHER; note = uracil
  modified_base 160: mod_base = OTHER; note = uracil
  modified_base 166: mod_base = OTHER; note = uracil
  modified_base 167: mod_base = OTHER; note = uracil
  modified_base 171: mod_base = OTHER; note = uracil
  modified_base 180: mod_base = OTHER; note = uracil
  modified_base 183: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 199: mod_base = OTHER; note = uracil
  modified_base 208: mod_base = OTHER; note = uracil
  modified_base 210: mod_base = OTHER; note = uracil
  modified_base 216: mod_base = OTHER; note = uracil
  modified_base 218: mod_base = OTHER; note = uracil
  modified_base 220: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 231: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 259: mod_base = OTHER; note = uracil
  modified_base 269: mod_base = OTHER; note = uracil
  modified_base 271: mod_base = OTHER; note = uracil
  modified_base 274: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 294: mod_base = OTHER; note = uracil
  modified_base 297: mod_base = OTHER; note = uracil
tttatttggttgtttgttgagatttagggttggagtatggttttgtgygggttatggttaggaatttggggtttttaygattttgtttaggtttaagttagaatgttagttttatattttttttgtyggtagtttggttgtatgtgttygagattggttttgaggttaaatagagaatataatttggttttaaggttgtttatgtgatttataggtttttaaatatttagttgttttttgaattttyggttgattatttaagatttttttttattaaggtatttaattattggtattata

SEQ ID NO: 85 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 15: mod_base = OTHER; note = uracil
  modified_base 16: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 31: mod_base = OTHER; note = uracil
  modified_base 36: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 55: mod_base = OTHER; note = uracil
  modified_base 57: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 94: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 107: mod_base = OTHER; note = uracil
  modified_base 108: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 125: mod_base = OTHER; note = uracil
  modified_base 129: mod_base = OTHER; note = uracil
  modified_base 139: mod_base = OTHER; note = uracil
  modified_base 140: mod_base = OTHER; note = uracil
  modified_base 144: mod_base = OTHER; note = uracil
  modified_base 158: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 174: mod_base = OTHER; note = uracil
  modified_base 181: mod_base = OTHER; note = uracil
  modified_base 182: mod_base = OTHER; note = uracil
  modified_base 187: mod_base = OTHER; note = uracil
  modified_base 192: mod_base = OTHER; note = uracil
  modified_base 201: mod_base = OTHER; note = uracil
  modified_base 204: mod_base = OTHER; note = uracil
  modified_base 207: mod_base = OTHER; note = uracil
  modified_base 213: mod_base = OTHER; note = uracil
  modified_base 224: mod_base = OTHER; note = uracil
  modified_base 227: mod_base = OTHER; note = uracil
  modified_base 229: mod_base = OTHER; note = uracil
  modified_base 234: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 272: mod_base = OTHER; note = uracil
  modified_base 273: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 294: mod_base = OTHER; note = uracil
  modified_base 295: mod_base = OTHER; note = uracil
  modified_base 299: mod_base = OTHER; note = uracil
  modified_base 300: mod_base = OTHER; note = uracil
ggggttygtagtggtttagtttgttttgggttttgttggatgtttttygagaattatygygtaattttttttagaggtttaatattttaygtgttgatttttygggtttgtgttttttttgtygtagattgaagygttttyggttgaaggtgaggttttgtattaaygagtygtagaagtttygggtagagttggtggggtagttttagaggttgggatttgatatttttgagtaggaggtgatygtttyggtattagttgtttgttagattttgaaggagtaaggtttgygattatatt

SEQ ID NO: 86 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 32: mod_base = OTHER; note = uracil
  modified_base 36: mod_base = OTHER; note = uracil
  modified_base 40: mod_base = OTHER; note = uracil
  modified_base 43: mod_base = OTHER; note = uracil
  modified_base 49: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 68: mod_base = OTHER; note = uracil
  modified_base 70: mod_base = OTHER; note = uracil
  modified_base 79: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 122: mod_base = OTHER; note = uracil
  modified_base 125: mod_base = OTHER; note = uracil
  modified_base 131: mod_base = OTHER; note = uracil
  modified_base 141: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 151: mod_base = OTHER; note = uracil
  modified_base 152: mod_base = OTHER; note = uracil
  modified_base 155: mod_base = OTHER; note = uracil
  modified_base 158: mod_base = OTHER; note = uracil
  modified_base 167: mod_base = OTHER; note = uracil
  modified_base 170: mod_base = OTHER; note = uracil
  modified_base 174: mod_base = OTHER; note = uracil
  modified_base 180: mod_base = OTHER; note = uracil
  modified_base 189: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 205: mod_base = OTHER; note = uracil
  modified_base 208: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 250: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 297: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ggtatggtygtaggttttgtttttttaggatttggtaggtagttggtgtyggggyggttattttttgtttagagatgttaaattttagtttttgaagttgttttattagttttgttygggatttttgygattygttggtgtagaattttatttttagtygggaaygttttagtttgyggtaggggagatataggttygggaagttagtaygtggagtgttgggtttttgaaggaggttgygyggtgattttygaagggtatttagtaaagtttagagtagattaggttattgygagtttt

SEQ ID NO: 87 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 11: mod_base = OTHER; note = uracil
  modified_base 18: mod_base = OTHER; note = uracil
  modified_base 19: mod_base = OTHER; note = uracil
  modified_base 35: mod_base = OTHER; note = uracil
  modified_base 41: mod_base = OTHER; note = uracil
  modified_base 43: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 62: mod_base = OTHER; note = uracil
  modified_base 65: mod_base = OTHER; note = uracil
  modified_base 68: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 81: mod_base = OTHER; note = uracil
  modified_base 83: mod_base = OTHER; note = uracil
  modified_base 91: mod_base = OTHER; note = uracil
  modified_base 96: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 128: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 138: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 158: mod_base = OTHER; note = uracil
  modified_base 162: mod_base = OTHER; note = uracil
  modified_base 163: mod_base = OTHER; note = uracil
  modified_base 171: mod_base = OTHER; note = uracil
  modified_base 189: mod_base = OTHER; note = uracil
  modified_base 205: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 219: mod_base = OTHER; note = uracil
  modified_base 222: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 242: mod_base = OTHER; note = uracil
  modified_base 243: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 259: mod_base = OTHER; note = uracil
  modified_base 266: mod_base = OTHER; note = uracil
  modified_base 273: mod_base = OTHER; note = uracil
  modified_base 275: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 292: mod_base = OTHER; note = uracil
  modified_base 300: mod_base = OTHER; note = uracil
gyggggttagtagygtgttyggygggaagyggtataggygtttygggaagtygygtattagttgttttagtattatgtygtttaggtyggtygtgtttttttgygaygggttgaagatgyggaygaatttttttyggtagtttatagttaygatttttaggtttgtygggttgggaagagaggagaygttgtgaggagatgyggtyggtttattygtatagttgygygtttygttyggaaattagttttagttyggygtyggaggtttgggttattygttttttatttttgtaggagttt

SEQ ID NO: 88 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 7: mod_base = OTHER; note = uracil
  modified_base 10: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 45: mod_base = OTHER; note = uracil
  modified_base 50: mod_base = OTHER; note = uracil
  modified_base 56: mod_base = OTHER; note = uracil
  modified_base 63: mod_base = OTHER; note = uracil
  modified_base 77: mod_base = OTHER; note = uracil
  modified_base 80: mod_base = OTHER; note = uracil
  modified_base 93: mod_base = OTHER; note = uracil
  modified_base 97: mod_base = OTHER; note = uracil
  modified_base 100: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 110: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 140: mod_base = OTHER; note = uracil
  modified_base 141: mod_base = OTHER; note = uracil
  modified_base 154: mod_base = OTHER; note = uracil
  modified_base 161: mod_base = OTHER; note = uracil
  modified_base 164: mod_base = OTHER; note = uracil
  modified_base 179: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 198: mod_base = OTHER; note = uracil
  modified_base 206: mod_base = OTHER; note = uracil
  modified_base 211: mod_base = OTHER; note = uracil
  modified_base 215: mod_base = OTHER; note = uracil
  modified_base 216: mod_base = OTHER; note = uracil
  modified_base 224: mod_base = OTHER; note = uracil
  modified_base 231: mod_base = OTHER; note = uracil
  modified_base 237: mod_base = OTHER; note = uracil
  modified_base 240: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 279: mod_base = OTHER; note = uracil
  modified_base 284: mod_base = OTHER; note = uracil
  modified_base 288: mod_base = OTHER; note = uracil
  modified_base 291: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gaatttttgtagaggtaaggggygagtgatttaagttttyggygtyggattggagttggttttygggyggggygygtagttgtgygggtggatyggtygtatttttttatagygttttttttttttttagttygataggtttgaagatygtggttgtgagttgtygggagaagttygttygtatttttaattygtygtaggagagtayggtygatttgagyggtatggtgttgaagtagttggtgygyggtttttyggagygtttgtatygtttttygtygggtaygttgttggtttygt

SEQ ID NO: 89 - DNA, 300 bp, synthetic construct
  misc_feature 1..300: note = Synthetic polynucleotide
  source 1..300: mol_type = other DNA
  modified_base 17: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 28: mod_base = OTHER; note = uracil
  modified_base 31: mod_base = OTHER; note = uracil
  modified_base 39: mod_base = OTHER; note = uracil
  modified_base 41: mod_base = OTHER; note = uracil
  modified_base 49: mod_base = OTHER; note = uracil
  modified_base 50: mod_base = OTHER; note = uracil
  modified_base 53: mod_base = OTHER; note = uracil
  modified_base 54: mod_base = OTHER; note = uracil
  modified_base 61: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 72: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 105: mod_base = OTHER; note = uracil
  modified_base 111: mod_base = OTHER; note = uracil
  modified_base 112: mod_base = OTHER; note = uracil
  modified_base 119: mod_base = OTHER; note = uracil
  modified_base 139: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 150: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 164: mod_base = OTHER; note = uracil
  modified_base 168: mod_base = OTHER; note = uracil
  modified_base 169: mod_base = OTHER; note = uracil
  modified_base 183: mod_base = OTHER; note = uracil
  modified_base 189: mod_base = OTHER; note = uracil
  modified_base 194: mod_base = OTHER; note = uracil
  modified_base 207: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 229: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 241: mod_base = OTHER; note = uracil
  modified_base 242: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 254: mod_base = OTHER; note = uracil
  modified_base 256: mod_base = OTHER; note = uracil
  modified_base 263: mod_base = OTHER; note = uracil
  modified_base 267: mod_base = OTHER; note = uracil
  modified_base 280: mod_base = OTHER; note = uracil
  modified_base 281: mod_base = OTHER; note = uracil
  modified_base 285: mod_base = OTHER; note = uracil
  modified_base 292: mod_base = OTHER; note = uracil
  modified_base 297: mod_base = OTHER; note = uracil
  modified_base 298: mod_base = OTHER; note = uracil
aggagtgtttggggtgtttttttttggttgtagtgggatataggtgtgtttttttaggaattgggttttgattatttttagtttaatattttygggtttgtgaattgtgatttgtgtgtygggatgggttttgtgggtttgttttattttygtattgttggatttggttaagtgggtgaaggttaaggtyggttagagttgagtttttgttttgtttttttttttgggttagatgttatattaggtttagtgatttatagggtaggtagttgggaaatattaggtagagggtaggttttg

SEQ ID NO: 90 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 7: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 49: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 66: mod_base = OTHER; note = uracil
  modified_base 69: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 87: mod_base = OTHER; note = uracil
  modified_base 92: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 105: mod_base = OTHER; note = uracil
  modified_base 109: mod_base = OTHER; note = uracil
  modified_base 113: mod_base = OTHER; note = uracil
  modified_base 114: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 134: mod_base = OTHER; note = uracil
  modified_base 135: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 183: mod_base = OTHER; note = uracil
  modified_base 185: mod_base = OTHER; note = uracil
  modified_base 187: mod_base = OTHER; note = uracil
  modified_base 192: mod_base = OTHER; note = uracil
  modified_base 194: mod_base = OTHER; note = uracil
  modified_base 199: mod_base = OTHER; note = uracil
  modified_base 201: mod_base = OTHER; note = uracil
  modified_base 205: mod_base = OTHER; note = uracil
  modified_base 206: mod_base = OTHER; note = uracil
  modified_base 220: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 243: mod_base = OTHER; note = uracil
  modified_base 244: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 268: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 294: mod_base = OTHER; note = uracil
  modified_base 296: mod_base = OTHER; note = uracil
  modified_base 298: mod_base = OTHER; note = uracil
  modified_base 299: mod_base = OTHER; note = uracil
taggatttgttttttgtttggtattttttaattgtttgttttatgagttattgggtttggtgtggtatttagtttaggagaggggataaggtagaaatttaattttgatyggttttagtttttatttatttggttagatttagtagtgyggggatggggtagatttataaaatttatttyggtatataggttatagtttataggttygggagtgttgggttggaagtagttagggtttagtttttaggaaggtatatttgtgttttattgtagttaagaggaagtattttaaatattttt

SEQ ID NO: 91 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 32: mod_base = OTHER; note = uracil
  modified_base 34: mod_base = OTHER; note = uracil
  modified_base 44: mod_base = OTHER; note = uracil
  modified_base 62: mod_base = OTHER; note = uracil
  modified_base 80: mod_base = OTHER; note = uracil
  modified_base 83: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 99: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 149: mod_base = OTHER; note = uracil
  modified_base 157: mod_base = OTHER; note = uracil
  modified_base 158: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 206: mod_base = OTHER; note = uracil
  modified_base 214: mod_base = OTHER; note = uracil
  modified_base 221: mod_base = OTHER; note = uracil
  modified_base 248: mod_base = OTHER; note = uracil
  modified_base 250: mod_base = OTHER; note = uracil
  modified_base 257: mod_base = OTHER; note = uracil
  modified_base 263: mod_base = OTHER; note = uracil
  modified_base 266: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 277: mod_base = OTHER; note = uracil
  modified_base 278: mod_base = OTHER; note = uracil
  modified_base 287: mod_base = OTHER; note = uracil
  modified_base 288: mod_base = OTHER; note = uracil
  modified_base 292: mod_base = OTHER; note = uracil
  modified_base 296: mod_base = OTHER; note = uracil
  modified_base 300: mod_base = OTHER; note = uracil
gtaggaattaggttagygtatgtaatgaaaatttttgygttatttttttagaaggatgtgattgtattttatgagtatgtagtagggttattatatattttttgtttttgggttttttttttgtgtgtagtttaggtttyggtttgtgttygagggttagayggttttatggtttttagtttttttygtagattatatagggaggtagygaggtagggtgtaaggatgttaggggtggaaggggtgatatygggagtaaagattgttattttttggtttggataaatttgtttgatattt

SEQ ID NO: 92 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 20: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 36: mod_base = OTHER; note = uracil
  modified_base 40: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 110: mod_base = OTHER; note = uracil
  modified_base 122: mod_base = OTHER; note = uracil
  modified_base 129: mod_base = OTHER; note = uracil
  modified_base 130: mod_base = OTHER; note = uracil
  modified_base 137: mod_base = OTHER; note = uracil
  modified_base 141: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 153: mod_base = OTHER; note = uracil
  modified_base 155: mod_base = OTHER; note = uracil
  modified_base 159: mod_base = OTHER; note = uracil
  modified_base 165: mod_base = OTHER; note = uracil
  modified_base 166: mod_base = OTHER; note = uracil
  modified_base 171: mod_base = OTHER; note = uracil
  modified_base 174: mod_base = OTHER; note = uracil
  modified_base 176: mod_base = OTHER; note = uracil
  modified_base 178: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 197: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 222: mod_base = OTHER; note = uracil
  modified_base 226: mod_base = OTHER; note = uracil
  modified_base 228: mod_base = OTHER; note = uracil
  modified_base 237: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 264: mod_base = OTHER; note = uracil
  modified_base 274: mod_base = OTHER; note = uracil
  modified_base 279: mod_base = OTHER; note = uracil
  modified_base 285: mod_base = OTHER; note = uracil
  modified_base 289: mod_base = OTHER; note = uracil
  modified_base 290: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gaatgttagataggtttatttaggttaaggggtagtagtttttgttttyggtgttattttttttatttttaatatttttgtattttgtttygttgtttttttgtgtgatttayggaggaaattggggattatagggtygtttggttttygagtataaatyggggtttgggttatatataggggaggggtttaggagtaaaaggtgtgtggtgattttgttgtatatttataaaatatagttatatttttttaaaaagataaygtaagagtttttattatataygttggtttgatttttgt

SEQ ID NO: 93 - DNA, 301 bp, synthetic construct
  misc_feature 1..301: note = Synthetic polynucleotide
  source 1..301: mol_type = other DNA
  modified_base 4: mod_base = OTHER; note = uracil
  modified_base 22: mod_base = OTHER; note = uracil
  modified_base 25: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 91: mod_base = OTHER; note = uracil
  modified_base 99: mod_base = OTHER; note = uracil
  modified_base 100: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 136: mod_base = OTHER; note = uracil
  modified_base 138: mod_base = OTHER; note = uracil
  modified_base 140: mod_base = OTHER; note = uracil
  modified_base 148: mod_base = OTHER; note = uracil
  modified_base 156: mod_base = OTHER; note = uracil
  modified_base 163: mod_base = OTHER; note = uracil
  modified_base 190: mod_base = OTHER; note = uracil
  modified_base 192: mod_base = OTHER; note = uracil
  modified_base 199: mod_base = OTHER; note = uracil
  modified_base 205: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 219: mod_base = OTHER; note = uracil
  modified_base 220: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 238: mod_base = OTHER; note = uracil
  modified_base 242: mod_base = OTHER; note = uracil
  modified_base 243: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 257: mod_base = OTHER; note = uracil
  modified_base 260: mod_base = OTHER; note = uracil
  modified_base 261: mod_base = OTHER; note = uracil
  modified_base 264: mod_base = OTHER; note = uracil
  modified_base 269: mod_base = OTHER; note = uracil
  modified_base 274: mod_base = OTHER; note = uracil
  modified_base 278: mod_base = OTHER; note = uracil
  modified_base 280: mod_base = OTHER; note = uracil
  modified_base 284: mod_base = OTHER; note = uracil
  modified_base 286: mod_base = OTHER; note = uracil
  modified_base 289: mod_base = OTHER; note = uracil
  modified_base 295: mod_base = OTHER; note = uracil
  modified_base 296: mod_base = OTHER; note = uracil
  modified_base 298: mod_base = OTHER; note = uracil
tgattgtattttatgagtatgtagtagggttattatatattttttgtttttgggttttttttttgtgtgtagtttaggtttyggtttgtgttygagggttagayggttttatggtttttagtttttttygtagattatatagggaggtagygaggtagggtgtaaggatgttaggggtggaaggggtgatatygggagtaaagattgttattttttggtttggataaatttgtttgatattttygatttttgaagttatttattatggttgygttggtttagatattttaagggttatttt

SEQ ID NO: 94 - DNA, 301 bp, synthetic construct
  misc_feature 1..301: note = Synthetic polynucleotide
  source 1..301: mol_type = other DNA
  modified_base 8: mod_base = OTHER; note = uracil
  modified_base 9: mod_base = OTHER; note = uracil
  modified_base 10: mod_base = OTHER; note = uracil
  modified_base 20: mod_base = OTHER; note = uracil
  modified_base 25: mod_base = OTHER; note = uracil
  modified_base 26: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 47: mod_base = OTHER; note = uracil
  modified_base 50: mod_base = OTHER; note = uracil
  modified_base 66: mod_base = OTHER; note = uracil
  modified_base 70: mod_base = OTHER; note = uracil
  modified_base 79: mod_base = OTHER; note = uracil
  modified_base 80: mod_base = OTHER; note = uracil
  modified_base 84: mod_base = OTHER; note = uracil
  modified_base 85: mod_base = OTHER; note = uracil
  modified_base 95: mod_base = OTHER; note = uracil
  modified_base 99: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 169: mod_base = OTHER; note = uracil
  modified_base 181: mod_base = OTHER; note = uracil
  modified_base 188: mod_base = OTHER; note = uracil
  modified_base 189: mod_base = OTHER; note = uracil
  modified_base 196: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 212: mod_base = OTHER; note = uracil
  modified_base 214: mod_base = OTHER; note = uracil
  modified_base 218: mod_base = OTHER; note = uracil
  modified_base 224: mod_base = OTHER; note = uracil
  modified_base 225: mod_base = OTHER; note = uracil
  modified_base 230: mod_base = OTHER; note = uracil
  modified_base 233: mod_base = OTHER; note = uracil
  modified_base 235: mod_base = OTHER; note = uracil
  modified_base 237: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 256: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 281: mod_base = OTHER; note = uracil
  modified_base 285: mod_base = OTHER; note = uracil
  modified_base 287: mod_base = OTHER; note = uracil
  modified_base 296: mod_base = OTHER; note = uracil
  modified_base 300: mod_base = OTHER; note = uracil
aaagtggtttttgaagtgtttgagttagygtagttatgatggatgattttagaggtygggaatgttagataggtttatttaggttaaggggtagtagtttttgttttyggtgttattttttttatttttaatatttttgtattttgtttygttgtttttttgtgtgatttayggaggaaattggggattatagggtygtttggttttygagtataaatyggggtttgggttatatataggggaggggtttaggagtaaaaggtgtgtggtgattttgttgtatatttataaaatatagtta

SEQ ID NO: 95 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 7: mod_base = OTHER; note = uracil
  modified_base 8: mod_base = OTHER; note = uracil
  modified_base 12: mod_base = OTHER; note = uracil
  modified_base 25: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 43: mod_base = OTHER; note = uracil
  modified_base 48: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 99: mod_base = OTHER; note = uracil
  modified_base 102: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 117: mod_base = OTHER; note = uracil
  modified_base 120: mod_base = OTHER; note = uracil
  modified_base 124: mod_base = OTHER; note = uracil
  modified_base 125: mod_base = OTHER; note = uracil
  modified_base 129: mod_base = OTHER; note = uracil
  modified_base 132: mod_base = OTHER; note = uracil
  modified_base 135: mod_base = OTHER; note = uracil
  modified_base 141: mod_base = OTHER; note = uracil
  modified_base 144: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 167: mod_base = OTHER; note = uracil
  modified_base 168: mod_base = OTHER; note = uracil
  modified_base 172: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 195: mod_base = OTHER; note = uracil
  modified_base 201: mod_base = OTHER; note = uracil
  modified_base 222: mod_base = OTHER; note = uracil
  modified_base 232: mod_base = OTHER; note = uracil
  modified_base 233: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 244: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 272: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 297: mod_base = OTHER; note = uracil
tatatattttttagttgaggggygttgaggtttttgttgttgttgtgtygtttgatttgttttttttttttgatagagagttagttgtttttygggaataattttattaatgagtgtaatatattaggtaattttatgtgtagtaatggayggtgtatttygggygtttggtagtgtgaygggttgtttgattgtttygataagagtgatgagaaggagtgtygtgagtggtttggttttttgttggggtggggtggtagttattttggggtagaggggagtaggttttgagtaggttta

SEQ ID NO: 96 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 9: mod_base = OTHER; note = uracil
  modified_base 11: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 65: mod_base = OTHER; note = uracil
  modified_base 66: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 75: mod_base = OTHER; note = uracil
  modified_base 80: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 88: mod_base = OTHER; note = uracil
  modified_base 90: mod_base = OTHER; note = uracil
  modified_base 93: mod_base = OTHER; note = uracil
  modified_base 95: mod_base = OTHER; note = uracil
  modified_base 97: mod_base = OTHER; note = uracil
  modified_base 107: mod_base = OTHER; note = uracil
  modified_base 111: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 161: mod_base = OTHER; note = uracil
  modified_base 163: mod_base = OTHER; note = uracil
  modified_base 173: mod_base = OTHER; note = uracil
  modified_base 174: mod_base = OTHER; note = uracil
  modified_base 185: mod_base = OTHER; note = uracil
  modified_base 187: mod_base = OTHER; note = uracil
  modified_base 189: mod_base = OTHER; note = uracil
  modified_base 205: mod_base = OTHER; note = uracil
  modified_base 206: mod_base = OTHER; note = uracil
  modified_base 214: mod_base = OTHER; note = uracil
  modified_base 217: mod_base = OTHER; note = uracil
  modified_base 221: mod_base = OTHER; note = uracil
  modified_base 223: mod_base = OTHER; note = uracil
  modified_base 225: mod_base = OTHER; note = uracil
  modified_base 229: mod_base = OTHER; note = uracil
  modified_base 242: mod_base = OTHER; note = uracil
  modified_base 247: mod_base = OTHER; note = uracil
  modified_base 254: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 265: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 287: mod_base = OTHER; note = uracil
taagtttgtttaggatttgtttttttttgttttaggatggttgttattttattttagtaaagggttaggttatttayggtatttttttttattatttttgtygaagtagttaggtagttygttatattgttaggygttygggatgtatygtttattgttgtatatgaagttgtttggtatgttgtatttattggtgaagttgttttyggggagtagttggttttttgttagagagaggggataggttagayggtatagtaatagtagggattttagygttttttaattgaaaggtgtgtg

SEQ ID NO: 97 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 38: mod_base = OTHER; note = uracil
  modified_base 40: mod_base = OTHER; note = uracil
  modified_base 42: mod_base = OTHER; note = uracil
  modified_base 47: mod_base = OTHER; note = uracil
  modified_base 49: mod_base = OTHER; note = uracil
  modified_base 58: mod_base = OTHER; note = uracil
  modified_base 65: mod_base = OTHER; note = uracil
  modified_base 71: mod_base = OTHER; note = uracil
  modified_base 73: mod_base = OTHER; note = uracil
  modified_base 77: mod_base = OTHER; note = uracil
  modified_base 78: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 92: mod_base = OTHER; note = uracil
  modified_base 102: mod_base = OTHER; note = uracil
  modified_base 112: mod_base = OTHER; note = uracil
  modified_base 117: mod_base = OTHER; note = uracil
  modified_base 119: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 149: mod_base = OTHER; note = uracil
  modified_base 150: mod_base = OTHER; note = uracil
  modified_base 153: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 171: mod_base = OTHER; note = uracil
  modified_base 174: mod_base = OTHER; note = uracil
  modified_base 183: mod_base = OTHER; note = uracil
  modified_base 193: mod_base = OTHER; note = uracil
  modified_base 212: mod_base = OTHER; note = uracil
  modified_base 213: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 228: mod_base = OTHER; note = uracil
  modified_base 237: mod_base = OTHER; note = uracil
  modified_base 243: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 260: mod_base = OTHER; note = uracil
  modified_base 261: mod_base = OTHER; note = uracil
  modified_base 269: mod_base = OTHER; note = uracil
  modified_base 275: mod_base = OTHER; note = uracil
  modified_base 278: mod_base = OTHER; note = uracil
  modified_base 285: mod_base = OTHER; note = uracil
  modified_base 286: mod_base = OTHER; note = uracil
  modified_base 296: mod_base = OTHER; note = uracil
  modified_base 297: mod_base = OTHER; note = uracil
  modified_base 299: mod_base = OTHER; note = uracil
tatgtattttgtgtttgtagtgtgttggttaygggagtattttaaatatattatgggtygggygtagtggtttyggtttgtaattttagtattttgggaggttgaggygggtagattatttgagtttaggagttygatattagtttggttaatayggygaaatttygtttttattaaaaatataaaaattaatygggtgtgatggygygtgtttgtatttttagttattagggaggttgaggtaggagaattttttgaatttgggaggtagggattgtagtgagttaagattgtgttatt

SEQ ID NO: 98 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 8: mod_base = OTHER; note = uracil
  modified_base 12: mod_base = OTHER; note = uracil
  modified_base 17: mod_base = OTHER; note = uracil
  modified_base 19: mod_base = OTHER; note = uracil
  modified_base 21: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 44: mod_base = OTHER; note = uracil
  modified_base 53: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 77: mod_base = OTHER; note = uracil
  modified_base 86: mod_base = OTHER; note = uracil
  modified_base 90: mod_base = OTHER; note = uracil
  modified_base 96: mod_base = OTHER; note = uracil
  modified_base 97: mod_base = OTHER; note = uracil
  modified_base 100: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 144: mod_base = OTHER; note = uracil
  modified_base 153: mod_base = OTHER; note = uracil
  modified_base 154: mod_base = OTHER; note = uracil
  modified_base 158: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 177: mod_base = OTHER; note = uracil
  modified_base 179: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 221: mod_base = OTHER; note = uracil
  modified_base 225: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 284: mod_base = OTHER; note = uracil
  modified_base 288: mod_base = OTHER; note = uracil
  modified_base 290: mod_base = OTHER; note = uracil
  modified_base 297: mod_base = OTHER; note = uracil
agtggtataattttggtttattgtagtttttgttttttaggtttaggagatttttttgttttagtttttttagtagttgggaatataggtaygygttattatattyggttaatttttgtatttttagtagagayggggtttygtygtgttggttaggttggtgtygaatttttgggtttaagtgatttgttygttttagttttttaaagtgttgagattataggtyggagttattgygttyggtttataatgtgtttagagtgttttygtggttagtatattataaatataaaatgtatg

SEQ ID NO: 99 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 26: mod_base = OTHER; note = uracil
  modified_base 33: mod_base = OTHER; note = uracil
  modified_base 42: mod_base = OTHER; note = uracil
  modified_base 47: mod_base = OTHER; note = uracil
  modified_base 50: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 72: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 99: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 156: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 167: mod_base = OTHER; note = uracil
  modified_base 174: mod_base = OTHER; note = uracil
  modified_base 185: mod_base = OTHER; note = uracil
  modified_base 188: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 207: mod_base = OTHER; note = uracil
  modified_base 221: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 236: mod_base = OTHER; note = uracil
  modified_base 242: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 253: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 271: mod_base = OTHER; note = uracil
  modified_base 279: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 293: mod_base = OTHER; note = uracil
  modified_base 296: mod_base = OTHER; note = uracil
ggattgtgggttttttggtttgtgtttgaaagttgggggtatagttttgtatgggttggtttttgttttatttygggaagtttttagagtttgttgggtagtttgttttttttttttatttttttygtttttattttttttttattatatttyggtttttttayggtyggaggtygtgaatgggttgttttgttgttyggtttatataggaggatggtggtagaagatttyggtataaagttagtatttattttgtttttaggttgggtttagggaggttgaaaagttattttagttgtg

SEQ ID NO: 100 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 6: mod_base = OTHER; note = uracil
  modified_base 15: mod_base = OTHER; note = uracil
  modified_base 20: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 46: mod_base = OTHER; note = uracil
  modified_base 57: mod_base = OTHER; note = uracil
  modified_base 61: mod_base = OTHER; note = uracil
  modified_base 68: mod_base = OTHER; note = uracil
  modified_base 75: mod_base = OTHER; note = uracil
  modified_base 78: mod_base = OTHER; note = uracil
  modified_base 81: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 101: mod_base = OTHER; note = uracil
  modified_base 106: mod_base = OTHER; note = uracil
  modified_base 109: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 128: mod_base = OTHER; note = uracil
  modified_base 129: mod_base = OTHER; note = uracil
  modified_base 131: mod_base = OTHER; note = uracil
  modified_base 135: mod_base = OTHER; note = uracil
  modified_base 146: mod_base = OTHER; note = uracil
  modified_base 196: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 212: mod_base = OTHER; note = uracil
  modified_base 214: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 236: mod_base = OTHER; note = uracil
  modified_base 242: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 257: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 269: mod_base = OTHER; note = uracil
  modified_base 273: mod_base = OTHER; note = uracil
  modified_base 277: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 299: mod_base = OTHER; note = uracil
  modified_base 300: mod_base = OTHER; note = uracil
tatagttgaagtggttttttagtttttttgaatttagtttgggaatagagtgggtgttgattttgtgtyggggttttttgttattatttttttgtgtgggtygggtaataaagtagtttatttayggttttyggtygtgggagagtyggaatgtggtgaggagggagtggagayggaggaggtgagaggaggaggtaggttgtttagtaggttttgggagtttttygaggtaaggtaggggttaatttatgtagaattgtatttttagtttttagatataaattaaggggtttatagttt

SEQ ID NO: 101 - DNA, 301 bp, synthetic construct
  misc_feature 1..301: note = Synthetic polynucleotide
  source 1..301: mol_type = other DNA
  modified_base 3: mod_base = OTHER; note = uracil
  modified_base 5: mod_base = OTHER; note = uracil
  modified_base 7: mod_base = OTHER; note = uracil
  modified_base 19: mod_base = OTHER; note = uracil
  modified_base 20: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 41: mod_base = OTHER; note = uracil
  modified_base 46: mod_base = OTHER; note = uracil
  modified_base 47: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 71: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 96: mod_base = OTHER; note = uracil
  modified_base 101: mod_base = OTHER; note = uracil
  modified_base 106: mod_base = OTHER; note = uracil
  modified_base 109: mod_base = OTHER; note = uracil
  modified_base 111: mod_base = OTHER; note = uracil
  modified_base 117: mod_base = OTHER; note = uracil
  modified_base 118: mod_base = OTHER; note = uracil
  modified_base 121: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 142: mod_base = OTHER; note = uracil
  modified_base 143: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 174: mod_base = OTHER; note = uracil
  modified_base 191: mod_base = OTHER; note = uracil
  modified_base 194: mod_base = OTHER; note = uracil
  modified_base 201: mod_base = OTHER; note = uracil
  modified_base 203: mod_base = OTHER; note = uracil
  modified_base 209: mod_base = OTHER; note = uracil
  modified_base 217: mod_base = OTHER; note = uracil
  modified_base 219: mod_base = OTHER; note = uracil
  modified_base 222: mod_base = OTHER; note = uracil
  modified_base 224: mod_base = OTHER; note = uracil
  modified_base 230: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 246: mod_base = OTHER; note = uracil
  modified_base 247: mod_base = OTHER; note = uracil
  modified_base 249: mod_base = OTHER; note = uracil
  modified_base 251: mod_base = OTHER; note = uracil
  modified_base 256: mod_base = OTHER; note = uracil
  modified_base 259: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 283: mod_base = OTHER; note = uracil
tatttttttgatgtatgattttggatgtgatttagtttttttgggttttggtttygttgaattatgtgattagagtattaagtyggttttttaygttggtttgagttgtttaagggttatttaggttttttttgttttaagttagaggtygttttttttyggttaagtygyggttatgggggtggtggtataatagagagtatagggattttggaatataatattgggttatgatttttgtttggttatttttggttgttgattttgattttttgtttttttttttgtgaatggggggagt

SEQ ID NO: 102 - DNA, 301 bp, synthetic construct
  misc_feature 1..301: note = Synthetic polynucleotide
  source 1..301: mol_type = other DNA
  modified_base 2: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 13: mod_base = OTHER; note = uracil
  modified_base 15: mod_base = OTHER; note = uracil
  modified_base 27: mod_base = OTHER; note = uracil
  modified_base 35: mod_base = OTHER; note = uracil
  modified_base 41: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 69: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 88: mod_base = OTHER; note = uracil
  modified_base 89: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 102: mod_base = OTHER; note = uracil
  modified_base 104: mod_base = OTHER; note = uracil
  modified_base 106: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 135: mod_base = OTHER; note = uracil
  modified_base 140: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 168: mod_base = OTHER; note = uracil
  modified_base 177: mod_base = OTHER; note = uracil
  modified_base 178: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 194: mod_base = OTHER; note = uracil
  modified_base 197: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 216: mod_base = OTHER; note = uracil
  modified_base 220: mod_base = OTHER; note = uracil
  modified_base 227: mod_base = OTHER; note = uracil
  modified_base 229: mod_base = OTHER; note = uracil
  modified_base 234: mod_base = OTHER; note = uracil
  modified_base 236: mod_base = OTHER; note = uracil
  modified_base 243: mod_base = OTHER; note = uracil
  modified_base 251: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 285: mod_base = OTHER; note = uracil
  modified_base 289: mod_base = OTHER; note = uracil
  modified_base 292: mod_base = OTHER; note = uracil
attttttttatttataaaggaggagatagagggttaaggttagtagttaagagtggttaggtaggggttatgatttagtgttgtgttttaaagtttttgtgttttttgttgtattattatttttatagtygyggtttggtyggggagaggygatttttggtttgggataaagaggatttagatggtttttgagtagtttagattagygtgggaggtyggtttggtgttttgattatatggtttagyggggttaaggtttagagaggttaaattatatttaaggttatatattaagagagta

SEQ ID NO: 103 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 18: mod_base = OTHER; note = uracil
  modified_base 19: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 47: mod_base = OTHER; note = uracil
  modified_base 52: mod_base = OTHER; note = uracil
  modified_base 60: mod_base = OTHER; note = uracil
  modified_base 72: mod_base = OTHER; note = uracil
  modified_base 76: mod_base = OTHER; note = uracil
  modified_base 78: mod_base = OTHER; note = uracil
  modified_base 80: mod_base = OTHER; note = uracil
  modified_base 85: mod_base = OTHER; note = uracil
  modified_base 89: mod_base = OTHER; note = uracil
  modified_base 90: mod_base = OTHER; note = uracil
  modified_base 100: mod_base = OTHER; note = uracil
  modified_base 104: mod_base = OTHER; note = uracil
  modified_base 116: mod_base = OTHER; note = uracil
  modified_base 119: mod_base = OTHER; note = uracil
  modified_base 121: mod_base = OTHER; note = uracil
  modified_base 131: mod_base = OTHER; note = uracil
  modified_base 134: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 150: mod_base = OTHER; note = uracil
  modified_base 154: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 176: mod_base = OTHER; note = uracil
  modified_base 177: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 189: mod_base = OTHER; note = uracil
  modified_base 192: mod_base = OTHER; note = uracil
  modified_base 198: mod_base = OTHER; note = uracil
  modified_base 204: mod_base = OTHER; note = uracil
  modified_base 208: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 226: mod_base = OTHER; note = uracil
  modified_base 228: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 247: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 266: mod_base = OTHER; note = uracil
  modified_base 267: mod_base = OTHER; note = uracil
  modified_base 277: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 289: mod_base = OTHER; note = uracil
  modified_base 290: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 299: mod_base = OTHER; note = uracil
gttatggagaaaatatgttatgtttttatggaaattaatttatttgtttaattgaggttttgggggtggttttgatatttagtgttaattagggggagtttggttgtgaggtygttagtatatggyggtgttgtyggttgttttttaygtaygtaggttttgttagtttgttttgttaatttgttaggtaattgggataggtgtagatatgatttaggttttaagtataygtatttatttttttygtygaggtattttttyggtgttatatgttgattttgtttagygttaggtagttta

SEQ ID NO: 104 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 8: mod_base = OTHER; note = uracil
  modified_base 9: mod_base = OTHER; note = uracil
  modified_base 15: mod_base = OTHER; note = uracil
  modified_base 20: mod_base = OTHER; note = uracil
  modified_base 26: mod_base = OTHER; note = uracil
  modified_base 29: mod_base = OTHER; note = uracil
  modified_base 36: mod_base = OTHER; note = uracil
  modified_base 38: mod_base = OTHER; note = uracil
  modified_base 49: mod_base = OTHER; note = uracil
  modified_base 50: mod_base = OTHER; note = uracil
  modified_base 76: mod_base = OTHER; note = uracil
  modified_base 83: mod_base = OTHER; note = uracil
  modified_base 84: mod_base = OTHER; note = uracil
  modified_base 90: mod_base = OTHER; note = uracil
  modified_base 95: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 113: mod_base = OTHER; note = uracil
  modified_base 114: mod_base = OTHER; note = uracil
  modified_base 118: mod_base = OTHER; note = uracil
  modified_base 126: mod_base = OTHER; note = uracil
  modified_base 131: mod_base = OTHER; note = uracil
  modified_base 135: mod_base = OTHER; note = uracil
  modified_base 139: mod_base = OTHER; note = uracil
  modified_base 144: mod_base = OTHER; note = uracil
  modified_base 145: mod_base = OTHER; note = uracil
  modified_base 161: mod_base = OTHER; note = uracil
  modified_base 164: mod_base = OTHER; note = uracil
  modified_base 168: mod_base = OTHER; note = uracil
  modified_base 171: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 183: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 217: mod_base = OTHER; note = uracil
  modified_base 219: mod_base = OTHER; note = uracil
  modified_base 227: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 255: mod_base = OTHER; note = uracil
  modified_base 270: mod_base = OTHER; note = uracil
  modified_base 271: mod_base = OTHER; note = uracil
  modified_base 279: mod_base = OTHER; note = uracil
  modified_base 284: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 300: mod_base = OTHER; note = uracil
tgggttgtttggygttgggtagagttaatatatggtatygggagagtgtttyggyggggagggtggatgygtgtgtttggagtttgggttatgtttgtatttgttttagttgtttggtagattggtaaggtaggttggtagagtttgygtgygtgggaggtagtyggtagtatygttatgtgttgaygattttatagttagattttttttggttagtattgagtgttagaattatttttagaattttagttaagtaaataggttggtttttatggagatatggtatattttttttatggt

SEQ ID NO: 105 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 36: mod_base = OTHER; note = uracil
  modified_base 39: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 55: mod_base = OTHER; note = uracil
  modified_base 59: mod_base = OTHER; note = uracil
  modified_base 63: mod_base = OTHER; note = uracil
  modified_base 65: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 97: mod_base = OTHER; note = uracil
  modified_base 103: mod_base = OTHER; note = uracil
  modified_base 109: mod_base = OTHER; note = uracil
  modified_base 113: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 131: mod_base = OTHER; note = uracil
  modified_base 133: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 158: mod_base = OTHER; note = uracil
  modified_base 160: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 182: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 194: mod_base = OTHER; note = uracil
  modified_base 195: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 233: mod_base = OTHER; note = uracil
gagtttggttgtgaggtygttagtatatggyggtgttgtyggttgttttttaygtaygtaggttttgttagtttgttttgttaatttgttaggtaattgggataggtgtagatatgatttaggttttaagtataygtatttatttttttygtygaggtattttttyggtgttatatgttgattttgtttagygttaggtagtttagygtttatttttttttttttagtttggttttaygtatagtgttttagtttttgttgggtagtgtgaggagtggtaatttgtaggtattttagaag

SEQ ID NO: 106 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 12: mod_base = OTHER; note = uracil
  modified_base 13: mod_base = OTHER; note = uracil
  modified_base 16: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 33: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 43: mod_base = OTHER; note = uracil
  modified_base 49: mod_base = OTHER; note = uracil
  modified_base 55: mod_base = OTHER; note = uracil
  modified_base 57: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 95: mod_base = OTHER; note = uracil
  modified_base 100: mod_base = OTHER; note = uracil
  modified_base 103: mod_base = OTHER; note = uracil
  modified_base 104: mod_base = OTHER; note = uracil
  modified_base 110: mod_base = OTHER; note = uracil
  modified_base 115: mod_base = OTHER; note = uracil
  modified_base 121: mod_base = OTHER; note = uracil
  modified_base 124: mod_base = OTHER; note = uracil
  modified_base 131: mod_base = OTHER; note = uracil
  modified_base 133: mod_base = OTHER; note = uracil
  modified_base 144: mod_base = OTHER; note = uracil
  modified_base 145: mod_base = OTHER; note = uracil
  modified_base 171: mod_base = OTHER; note = uracil
  modified_base 178: mod_base = OTHER; note = uracil
  modified_base 179: mod_base = OTHER; note = uracil
  modified_base 185: mod_base = OTHER; note = uracil
  modified_base 190: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 221: mod_base = OTHER; note = uracil
  modified_base 226: mod_base = OTHER; note = uracil
  modified_base 230: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 256: mod_base = OTHER; note = uracil
  modified_base 259: mod_base = OTHER; note = uracil
  modified_base 263: mod_base = OTHER; note = uracil
  modified_base 266: mod_base = OTHER; note = uracil
  modified_base 268: mod_base = OTHER; note = uracil
  modified_base 271: mod_base = OTHER; note = uracil
  modified_base 272: mod_base = OTHER; note = uracil
  modified_base 278: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 298: mod_base = OTHER; note = uracil
  modified_base 300: mod_base = OTHER; note = uracil
tttttagggtgtttgtagattgttattttttatattatttagtagaggttagagtattgtgygtggggttaggttggggagggggaggtgggygttgggttgtttggygttgggtagagttaatatatggtatygggagagtgtttyggyggggagggtggatgygtgtgtttggagtttgggttatgtttgtatttgttttagttgtttggtagattggtaaggtaggttggtagagtttgygtgygtgggaggtagtyggtagtatygttatgtgttgaygattttatagttagattt

SEQ ID NO: 107 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 9: mod_base = OTHER; note = uracil
  modified_base 16: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 35: mod_base = OTHER; note = uracil
  modified_base 38: mod_base = OTHER; note = uracil
  modified_base 40: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 60: mod_base = OTHER; note = uracil
  modified_base 61: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 116: mod_base = OTHER; note = uracil
  modified_base 122: mod_base = OTHER; note = uracil
  modified_base 128: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 157: mod_base = OTHER; note = uracil
  modified_base 160: mod_base = OTHER; note = uracil
  modified_base 161: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 199: mod_base = OTHER; note = uracil
  modified_base 200: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 210: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 238: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 249: mod_base = OTHER; note = uracil
  modified_base 250: mod_base = OTHER; note = uracil
  modified_base 274: mod_base = OTHER; note = uracil
  modified_base 282: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 298: mod_base = OTHER; note = uracil
  modified_base 299: mod_base = OTHER; note = uracil
  modified_base 300: mod_base = OTHER; note = uracil
gtygaatttygagggtygagtattttttttttagtygtattgtatttgttygtaggtgattaatttaygggyggatttttagatttaattttttttagagttagggtgggatgggtagggataggagtyggaggttttattggtttygggygaaggtattttggaaagtatttagagygtttagtatttttttygyggttattygtaggttgatygatttttgggtagatttttagatttaatttagtttagggyggattaaggagtgggagataagggagtyggtggtttygttggttt

SEQ ID NO: 108 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 37: mod_base = OTHER; note = uracil
  modified_base 38: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 54: mod_base = OTHER; note = uracil
  modified_base 65: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 103: mod_base = OTHER; note = uracil
  modified_base 117: mod_base = OTHER; note = uracil
  modified_base 124: mod_base = OTHER; note = uracil
  modified_base 126: mod_base = OTHER; note = uracil
  modified_base 133: mod_base = OTHER; note = uracil
  modified_base 137: mod_base = OTHER; note = uracil
  modified_base 138: mod_base = OTHER; note = uracil
  modified_base 145: mod_base = OTHER; note = uracil
  modified_base 146: mod_base = OTHER; note = uracil
  modified_base 151: mod_base = OTHER; note = uracil
  modified_base 152: mod_base = OTHER; note = uracil
  modified_base 158: mod_base = OTHER; note = uracil
  modified_base 159: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 203: mod_base = OTHER; note = uracil
  modified_base 219: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 253: mod_base = OTHER; note = uracil
  modified_base 259: mod_base = OTHER; note = uracil
  modified_base 267: mod_base = OTHER; note = uracil
  modified_base 281: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 300: mod_base = OTHER; note = uracil
gggttagyggggttatyggtttttttgttttttattttttaattygttttggattggattgagtttgagggtttgtttaggggtyggttagtttgygggtggtygygggagggatgttggaygttttggatgttttttaggatgttttygttyggggttagtagggttttyggtttttgtttttgtttattttattttggttttggagaggattgggtttgggggttygttygtgggttggttatttaygggtaggtgtagtgyggttgagggaggggtgttyggttttygggattyggt

SEQ ID NO: 109 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 9: mod_base = OTHER; note = uracil
  modified_base 10: mod_base = OTHER; note = uracil
  modified_base 20: mod_base = OTHER; note = uracil
  modified_base 23: mod_base = OTHER; note = uracil
  modified_base 27: mod_base = OTHER; note = uracil
  modified_base 32: mod_base = OTHER; note = uracil
  modified_base 40: mod_base = OTHER; note = uracil
  modified_base 41: mod_base = OTHER; note = uracil
  modified_base 47: mod_base = OTHER; note = uracil
  modified_base 53: mod_base = OTHER; note = uracil
  modified_base 55: mod_base = OTHER; note = uracil
  modified_base 66: mod_base = OTHER; note = uracil
  modified_base 67: mod_base = OTHER; note = uracil
  modified_base 84: mod_base = OTHER; note = uracil
  modified_base 90: mod_base = OTHER; note = uracil
  modified_base 100: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 115: mod_base = OTHER; note = uracil
  modified_base 124: mod_base = OTHER; note = uracil
  modified_base 128: mod_base = OTHER; note = uracil
  modified_base 130: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 149: mod_base = OTHER; note = uracil
  modified_base 159: mod_base = OTHER; note = uracil
  modified_base 164: mod_base = OTHER; note = uracil
  modified_base 169: mod_base = OTHER; note = uracil
  modified_base 174: mod_base = OTHER; note = uracil
  modified_base 176: mod_base = OTHER; note = uracil
  modified_base 182: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 204: mod_base = OTHER; note = uracil
  modified_base 208: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 226: mod_base = OTHER; note = uracil
  modified_base 229: mod_base = OTHER; note = uracil
  modified_base 238: mod_base = OTHER; note = uracil
  modified_base 250: mod_base = OTHER; note = uracil
  modified_base 255: mod_base = OTHER; note = uracil
  modified_base 259: mod_base = OTHER; note = uracil
  modified_base 269: mod_base = OTHER; note = uracil
  modified_base 270: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 285: mod_base = OTHER; note = uracil
  modified_base 294: mod_base = OTHER; note = uracil
  modified_base 300: mod_base = OTHER; note = uracil
ttgtttgattaaaagaatgtagtagatataattttgagatttggagttaggttataagaygattttttgggttttgtggaattttygttttgaaagaaataagttattaagtggtygggtgagttggtttaygtttgtaattttagtattttgggaggtygagtygggtygattataaggttaggagatygagattattttggttaatatggtgaaatttygtttttattaaaaatataaaaaaattagtygggtatattggygggygtttgtagttttagttattygggaggttgaggt

SEQ ID NO: 110 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 8: mod_base = OTHER; note = uracil
  modified_base 9: mod_base = OTHER; note = uracil
  modified_base 11: mod_base = OTHER; note = uracil
  modified_base 12: mod_base = OTHER; note = uracil
  modified_base 20: mod_base = OTHER; note = uracil
  modified_base 26: mod_base = OTHER; note = uracil
  modified_base 29: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 98: mod_base = OTHER; note = uracil
  modified_base 99: mod_base = OTHER; note = uracil
  modified_base 108: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 133: mod_base = OTHER; note = uracil
  modified_base 134: mod_base = OTHER; note = uracil
  modified_base 138: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 155: mod_base = OTHER; note = uracil
  modified_base 164: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 198: mod_base = OTHER; note = uracil
  modified_base 205: mod_base = OTHER; note = uracil
  modified_base 209: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 243: mod_base = OTHER; note = uracil
  modified_base 250: mod_base = OTHER; note = uracil
  modified_base 251: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 263: mod_base = OTHER; note = uracil
  modified_base 265: mod_base = OTHER; note = uracil
  modified_base 276: mod_base = OTHER; note = uracil
  modified_base 279: mod_base = OTHER; note = uracil
  modified_base 282: mod_base = OTHER; note = uracil
  modified_base 286: mod_base = OTHER; note = uracil
  modified_base 294: mod_base = OTHER; note = uracil
  modified_base 298: mod_base = OTHER; note = uracil
gttttagtttttygagtagttgggattataggygttygttagtatgttyggttaatttttttgtatttttagtagagayggggttttattatgttagttaggatggtttygattttttgattttgtgatyggttyggttyggttttttaaagtgttgggattataggygtgagttagtttattyggttatttggtggtttgttttttttagaaygagaattttataaaatttaggaaatygttttgtgatttagttttaggttttaaagttatgtttgttgtatttttttggttaagtaa

SEQ ID NO: 111 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 10: mod_base = OTHER; note = uracil
  modified_base 14: mod_base = OTHER; note = uracil
  modified_base 21: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 44: mod_base = OTHER; note = uracil
  modified_base 46: mod_base = OTHER; note = uracil
  modified_base 50: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 78: mod_base = OTHER; note = uracil
  modified_base 81: mod_base = OTHER; note = uracil
  modified_base 84: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 110: mod_base = OTHER; note = uracil
  modified_base 113: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 130: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 147: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 169: mod_base = OTHER; note = uracil
  modified_base 171: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 191: mod_base = OTHER; note = uracil
  modified_base 202: mod_base = OTHER; note = uracil
  modified_base 205: mod_base = OTHER; note = uracil
  modified_base 210: mod_base = OTHER; note = uracil
  modified_base 212: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 240: mod_base = OTHER; note = uracil
  modified_base 246: mod_base = OTHER; note = uracil
  modified_base 253: mod_base = OTHER; note = uracil
  modified_base 256: mod_base = OTHER; note = uracil
  modified_base 262: mod_base = OTHER; note = uracil
  modified_base 264: mod_base = OTHER; note = uracil
  modified_base 271: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 292: mod_base = OTHER; note = uracil
  modified_base 296: mod_base = OTHER; note = uracil
agaatttgtttagtaggyggtttttttttgtttttttatygagtatagatygtgggaggggattttgygggaggaggttgttttagtttttagagattattttttatttttatagygatttttttatgatygttttttattyggtgttttygggttayggggaagggatattygggaaagatattagagatygggagggtgtagttgggtttttygyggggagygggygggaggtttttttgttatatgtygtagttgggatatagayggtagygttttagggtttatttgtyggtttyg

SEQ ID NO: 112 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 10: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 31: mod_base = OTHER; note = uracil
  modified_base 35: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 52: mod_base = OTHER; note = uracil
  modified_base 59: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 97: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 112: mod_base = OTHER; note = uracil
  modified_base 114: mod_base = OTHER; note = uracil
  modified_base 121: mod_base = OTHER; note = uracil
  modified_base 125: mod_base = OTHER; note = uracil
  modified_base 126: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 147: mod_base = OTHER; note = uracil
  modified_base 148: mod_base = OTHER; note = uracil
  modified_base 155: mod_base = OTHER; note = uracil
  modified_base 157: mod_base = OTHER; note = uracil
  modified_base 173: mod_base = OTHER; note = uracil
  modified_base 186: mod_base = OTHER; note = uracil
  modified_base 206: mod_base = OTHER; note = uracil
  modified_base 208: mod_base = OTHER; note = uracil
  modified_base 215: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 258: mod_base = OTHER; note = uracil
  modified_base 271: mod_base = OTHER; note = uracil
  modified_base 281: mod_base = OTHER; note = uracil
  modified_base 284: mod_base = OTHER; note = uracil
  modified_base 285: mod_base = OTHER; note = uracil
  modified_base 288: mod_base = OTHER; note = uracil
  modified_base 293: mod_base = OTHER; note = uracil
  modified_base 299: mod_base = OTHER; note = uracil
ygaagtyggtaagtggattttggagygttgtygtttgtgttttagttgygatatgtaataggaaggtttttygttygtttttygygaagagtttagttgtattttttyggtttttggtgtttttttygagtgtttttttttygtggttygagagtatygggtgggggayggttataggggagtygttgtagagatgggagatggtttttggagattgaagtagttttttttygtagggtttttttttayggtttgtgttyggtgggggagtaggggagagtygtttgttaggtagatttt

SEQ ID NO: 113 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 17: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 57: mod_base = OTHER; note = uracil
  modified_base 61: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 72: mod_base = OTHER; note = uracil
  modified_base 78: mod_base = OTHER; note = uracil
  modified_base 79: mod_base = OTHER; note = uracil
  modified_base 91: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 105: mod_base = OTHER; note = uracil
  modified_base 113: mod_base = OTHER; note = uracil
  modified_base 114: mod_base = OTHER; note = uracil
  modified_base 118: mod_base = OTHER; note = uracil
  modified_base 119: mod_base = OTHER; note = uracil
  modified_base 124: mod_base = OTHER; note = uracil
  modified_base 126: mod_base = OTHER; note = uracil
  modified_base 131: mod_base = OTHER; note = uracil
  modified_base 136: mod_base = OTHER; note = uracil
  modified_base 143: mod_base = OTHER; note = uracil
  modified_base 144: mod_base = OTHER; note = uracil
  modified_base 151: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 203: mod_base = OTHER; note = uracil
  modified_base 206: mod_base = OTHER; note = uracil
  modified_base 210: mod_base = OTHER; note = uracil
  modified_base 213: mod_base = OTHER; note = uracil
  modified_base 215: mod_base = OTHER; note = uracil
  modified_base 225: mod_base = OTHER; note = uracil
  modified_base 230: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 274: mod_base = OTHER; note = uracil
  modified_base 281: mod_base = OTHER; note = uracil
  modified_base 286: mod_base = OTHER; note = uracil
  modified_base 291: mod_base = OTHER; note = uracil
  modified_base 296: mod_base = OTHER; note = uracil
aggtttaggtagaggttagagtttaagttttgttttygaaggaaatgtgttttatgttaattattttatagttgaggtttggagggaagttagggattttgggattggttattttggttttgatttattattgtttyggagatttaaaygtattttgagttattagaygtgggtgttaatatttgaggttaattttttgaygttttyggttgttttggaggaagttggtttttttttttattttttgtttttygtgttagtttggtatagagttaaggggtttggttgggtttggttggg

SEQ ID NO: 114 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 28: mod_base = OTHER; note = uracil
  modified_base 30: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 44: mod_base = OTHER; note = uracil
  modified_base 53: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 88: mod_base = OTHER; note = uracil
  modified_base 91: mod_base = OTHER; note = uracil
  modified_base 101: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 134: mod_base = OTHER; note = uracil
  modified_base 141: mod_base = OTHER; note = uracil
  modified_base 143: mod_base = OTHER; note = uracil
  modified_base 159: mod_base = OTHER; note = uracil
  modified_base 161: mod_base = OTHER; note = uracil
  modified_base 167: mod_base = OTHER; note = uracil
  modified_base 178: mod_base = OTHER; note = uracil
  modified_base 183: mod_base = OTHER; note = uracil
  modified_base 184: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 229: mod_base = OTHER; note = uracil
  modified_base 244: mod_base = OTHER; note = uracil
  modified_base 251: mod_base = OTHER; note = uracil
  modified_base 253: mod_base = OTHER; note = uracil
  modified_base 258: mod_base = OTHER; note = uracil
  modified_base 259: mod_base = OTHER; note = uracil
  modified_base 268: mod_base = OTHER; note = uracil
  modified_base 273: mod_base = OTHER; note = uracil
  modified_base 279: mod_base = OTHER; note = uracil
  modified_base 281: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 297: mod_base = OTHER; note = uracil
  modified_base 298: mod_base = OTHER; note = uracil
ttagttaagtttagttaagttttttgattttgtattaggttggtayggaaaataggaggtgggagggaggattagttttttttagagtagtyggaagygttagggggttgattttaggtgttaatatttaygtttggtggtttagggtgygtttaggttttyggaatagtaatgagttaaggttaggataattagttttagggtttttgatttttttttaggttttagttatggagtagttagtatgggatatatttttttyggggatagggtttgggttttgatttttgtttgggtttg

SEQ ID NO: 115 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 7: mod_base = OTHER; note = uracil
  modified_base 11: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 22: mod_base = OTHER; note = uracil
  modified_base 28: mod_base = OTHER; note = uracil
  modified_base 29: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 55: mod_base = OTHER; note = uracil
  modified_base 63: mod_base = OTHER; note = uracil
  modified_base 64: mod_base = OTHER; note = uracil
  modified_base 68: mod_base = OTHER; note = uracil
  modified_base 69: mod_base = OTHER; note = uracil
  modified_base 74: mod_base = OTHER; note = uracil
  modified_base 76: mod_base = OTHER; note = uracil
  modified_base 81: mod_base = OTHER; note = uracil
  modified_base 86: mod_base = OTHER; note = uracil
  modified_base 93: mod_base = OTHER; note = uracil
  modified_base 94: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 153: mod_base = OTHER; note = uracil
  modified_base 156: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 175: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 202: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 218: mod_base = OTHER; note = uracil
  modified_base 224: mod_base = OTHER; note = uracil
  modified_base 231: mod_base = OTHER; note = uracil
  modified_base 236: mod_base = OTHER; note = uracil
  modified_base 241: mod_base = OTHER; note = uracil
  modified_base 246: mod_base = OTHER; note = uracil
  modified_base 251: mod_base = OTHER; note = uracil
  modified_base 253: mod_base = OTHER; note = uracil
  modified_base 264: mod_base = OTHER; note = uracil
  modified_base 268: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 286: mod_base = OTHER; note = uracil
  modified_base 296: mod_base = OTHER; note = uracil
tttatgttaattattttatagttgaggtttggagggaagttagggattttgggattggttattttggttttgatttattattgtttyggagatttaaaygtattttgagttattagaygtgggtgttaatatttgaggttaattttttgaygttttyggttgttttggaggaagttggtttttttttttattttttgtttttygtgttagtttggtatagagttaaggggtttggttgggtttggttgggtttagaaaygtggtagttaggagttagtttgygggtagyggggtgttggg

SEQ ID NO: 116 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 6: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 13: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 24: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 46: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 79: mod_base = OTHER; note = uracil
  modified_base 81: mod_base = OTHER; note = uracil
  modified_base 86: mod_base = OTHER; note = uracil
  modified_base 87: mod_base = OTHER; note = uracil
  modified_base 91: mod_base = OTHER; note = uracil
  modified_base 95: mod_base = OTHER; note = uracil
  modified_base 104: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 139: mod_base = OTHER; note = uracil
  modified_base 142: mod_base = OTHER; note = uracil
  modified_base 152: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 185: mod_base = OTHER; note = uracil
  modified_base 192: mod_base = OTHER; note = uracil
  modified_base 194: mod_base = OTHER; note = uracil
  modified_base 210: mod_base = OTHER; note = uracil
  modified_base 212: mod_base = OTHER; note = uracil
  modified_base 218: mod_base = OTHER; note = uracil
  modified_base 229: mod_base = OTHER; note = uracil
  modified_base 234: mod_base = OTHER; note = uracil
  modified_base 235: mod_base = OTHER; note = uracil
  modified_base 243: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 280: mod_base = OTHER; note = uracil
  modified_base 295: mod_base = OTHER; note = uracil
tttagtatttygttgttygtaggttggtttttgattgttaygtttttgagtttagttaagtttagttaagttttttgattttgtattaggttggtayggaaaataggaggtgggagggaggattagttttttttagagtagtyggaagygttagggggttgattttaggtgttaatatttaygtttggtggtttagggtgygtttaggttttyggaatagtaatgagttaaggttaggataattagttttagggtttttgatttttttttaggttttagttatggagtagttagtatggg

SEQ ID NO: 117 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 10: mod_base = OTHER; note = uracil
  modified_base 16: mod_base = OTHER; note = uracil
  modified_base 19: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 44: mod_base = OTHER; note = uracil
  modified_base 60: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 84: mod_base = OTHER; note = uracil
  modified_base 88: mod_base = OTHER; note = uracil
  modified_base 89: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 156: mod_base = OTHER; note = uracil
  modified_base 157: mod_base = OTHER; note = uracil
  modified_base 166: mod_base = OTHER; note = uracil
  modified_base 167: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 180: mod_base = OTHER; note = uracil
  modified_base 183: mod_base = OTHER; note = uracil
  modified_base 190: mod_base = OTHER; note = uracil
  modified_base 191: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 209: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 243: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 259: mod_base = OTHER; note = uracil
  modified_base 261: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 283: mod_base = OTHER; note = uracil
  modified_base 284: mod_base = OTHER; note = uracil
  modified_base 285: mod_base = OTHER; note = uracil
  modified_base 291: mod_base = OTHER; note = uracil
  modified_base 297: mod_base = OTHER; note = uracil
  modified_base 298: mod_base = OTHER; note = uracil
tttttttygtagttttattygttttttttttygtttttgygagttgggtttggggaygtttgggtggaatgtagatttataggttgtttttggtgttttttttttttgttttttagygttttagttttagatattagttttttagygggygaaagttygggagygtttttttygaaagatattagggtgttaygyggtttttgttttgtagaagtatttttttttygtttttgtttggaaagtaggtttttttttaagttttgygttttttttttttgggygttttyggatygtggttyg

SEQ ID NO: 118 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 12: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 38: mod_base = OTHER; note = uracil
  modified_base 43: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 63: mod_base = OTHER; note = uracil
  modified_base 64: mod_base = OTHER; note = uracil
  modified_base 68: mod_base = OTHER; note = uracil
  modified_base 87: mod_base = OTHER; note = uracil
  modified_base 90: mod_base = OTHER; note = uracil
  modified_base 93: mod_base = OTHER; note = uracil
  modified_base 98: mod_base = OTHER; note = uracil
  modified_base 104: mod_base = OTHER; note = uracil
  modified_base 112: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 123: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 146: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 164: mod_base = OTHER; note = uracil
  modified_base 171: mod_base = OTHER; note = uracil
  modified_base 177: mod_base = OTHER; note = uracil
  modified_base 185: mod_base = OTHER; note = uracil
  modified_base 193: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 227: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 262: mod_base = OTHER; note = uracil
  modified_base 289: mod_base = OTHER; note = uracil
ygggttayggttygagggygtttagggaagaagggygtagagtttagggaggggtttgttttttaggtaggggygggagggggatgtttttgtagggtaggggtygygtggtattttgatgtttttyggggaaggygttttygggttttygttygttgggggattggtgtttggggttggggygttggagaatagggaggaagggtattaaggatagtttgtgggtttatattttatttagaygtttttaaatttagttygtagaggyggggaggaggayggatgaaattgyggggagag

SEQ ID NO: 119 - DNA, 300 bp, synthetic construct
  misc_feature 1..300: note = Synthetic polynucleotide
  source 1..300: mol_type = other DNA
  modified_base 17: mod_base = OTHER; note = uracil
  modified_base 20: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 42: mod_base = OTHER; note = uracil
  modified_base 50: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 64: mod_base = OTHER; note = uracil
  modified_base 65: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 86: mod_base = OTHER; note = uracil
  modified_base 92: mod_base = OTHER; note = uracil
  modified_base 93: mod_base = OTHER; note = uracil
  modified_base 106: mod_base = OTHER; note = uracil
  modified_base 111: mod_base = OTHER; note = uracil
  modified_base 119: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 152: mod_base = OTHER; note = uracil
  modified_base 157: mod_base = OTHER; note = uracil
  modified_base 159: mod_base = OTHER; note = uracil
  modified_base 164: mod_base = OTHER; note = uracil
  modified_base 167: mod_base = OTHER; note = uracil
  modified_base 171: mod_base = OTHER; note = uracil
  modified_base 173: mod_base = OTHER; note = uracil
  modified_base 177: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 229: mod_base = OTHER; note = uracil
  modified_base 234: mod_base = OTHER; note = uracil
  modified_base 243: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 260: mod_base = OTHER; note = uracil
  modified_base 261: mod_base = OTHER; note = uracil
  modified_base 263: mod_base = OTHER; note = uracil
  modified_base 269: mod_base = OTHER; note = uracil
  modified_base 271: mod_base = OTHER; note = uracil
  modified_base 276: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 300: mod_base = OTHER; note = uracil
agaggagtggggagygtagtagggtggttttygttttygtttagaggagttggttttttaaggttaggtttaggygggtygggaatagagattygggaatgtgggttggattggggagtagagttatttagtatgagttattttygtttygtyggatttttygtygttggttttygtttgtygtttttttttggttttggttttggtttttgygttttttttgtagagttggttygggtgggttggyggtttttattygttataagygtatagggttttgtttatttttygttttttttt

SEQ ID NO: 120 - DNA, 300 bp, synthetic construct
  misc_feature 1..300: note = Synthetic polynucleotide
  source 1..300: mol_type = other DNA
  modified_base 21: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 35: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 75: mod_base = OTHER; note = uracil
  modified_base 78: mod_base = OTHER; note = uracil
  modified_base 89: mod_base = OTHER; note = uracil
  modified_base 95: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 107: mod_base = OTHER; note = uracil
  modified_base 108: mod_base = OTHER; note = uracil
  modified_base 121: mod_base = OTHER; note = uracil
  modified_base 131: mod_base = OTHER; note = uracil
  modified_base 132: mod_base = OTHER; note = uracil
  modified_base 146: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 178: mod_base = OTHER; note = uracil
  modified_base 180: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 211: mod_base = OTHER; note = uracil
  modified_base 213: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 233: mod_base = OTHER; note = uracil
  modified_base 234: mod_base = OTHER; note = uracil
  modified_base 238: mod_base = OTHER; note = uracil
  modified_base 239: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 257: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 299: mod_base = OTHER; note = uracil
gaaaaggggyggggagtgggtagagttttgtgygtttgtggygggtggaggtygttagtttattyggattagttttgtagggagggygtagaggttagggttagggttaggggagggyggtaagygagagttagyggygaagagttyggygaaaygggaatgatttatgttgggtggttttgttttttagtttagtttatattttygggtttttgttttygattygtttgggtttggttttaaagggttagtttttttgagygggagygggggttattttgttgygttttttattttttt

SEQ ID NO: 121 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 22: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 36: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 102: mod_base = OTHER; note = uracil
  modified_base 116: mod_base = OTHER; note = uracil
  modified_base 121: mod_base = OTHER; note = uracil
  modified_base 136: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 160: mod_base = OTHER; note = uracil
  modified_base 166: mod_base = OTHER; note = uracil
  modified_base 177: mod_base = OTHER; note = uracil
  modified_base 183: mod_base = OTHER; note = uracil
  modified_base 184: mod_base = OTHER; note = uracil
  modified_base 201: mod_base = OTHER; note = uracil
  modified_base 208: mod_base = OTHER; note = uracil
  modified_base 209: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 225: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 233: mod_base = OTHER; note = uracil
  modified_base 234: mod_base = OTHER; note = uracil
  modified_base 242: mod_base = OTHER; note = uracil
  modified_base 248: mod_base = OTHER; note = uracil
  modified_base 252: mod_base = OTHER; note = uracil
  modified_base 254: mod_base = OTHER; note = uracil
  modified_base 258: mod_base = OTHER; note = uracil
  modified_base 260: mod_base = OTHER; note = uracil
  modified_base 270: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 288: mod_base = OTHER; note = uracil
  modified_base 289: mod_base = OTHER; note = uracil
gtygagygyggtggtttatgtttgtaattttagtattttgggagayggaggtgggtggattattttaggttagaagtttgagatttttgtttttattgaaattataaaaaattggtygggtatggtggtgggtgtttgtagttttagttaygtggtaagttgaggtaggagaatgatttgaattygggaggyggaggttgtagtgagttaggattgygttattgtattttagtttgggagatagagttagattttgttttaaaaaaaagttatgggtttgtaggatgtttaatataaaag

SEQ ID NO: 122 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 45: mod_base = OTHER; note = uracil
  modified_base 51: mod_base = OTHER; note = uracil
  modified_base 55: mod_base = OTHER; note = uracil
  modified_base 57: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 69: mod_base = OTHER; note = uracil
  modified_base 77: mod_base = OTHER; note = uracil
  modified_base 85: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 101: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 121: mod_base = OTHER; note = uracil
  modified_base 126: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 154: mod_base = OTHER; note = uracil
  modified_base 160: mod_base = OTHER; note = uracil
  modified_base 163: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 187: mod_base = OTHER; note = uracil
  modified_base 203: mod_base = OTHER; note = uracil
  modified_base 212: mod_base = OTHER; note = uracil
  modified_base 219: mod_base = OTHER; note = uracil
  modified_base 221: mod_base = OTHER; note = uracil
  modified_base 225: mod_base = OTHER; note = uracil
  modified_base 228: mod_base = OTHER; note = uracil
  modified_base 232: mod_base = OTHER; note = uracil
  modified_base 233: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 268: mod_base = OTHER; note = uracil
  modified_base 277: mod_base = OTHER; note = uracil
  modified_base 281: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 295: mod_base = OTHER; note = uracil
  modified_base 300: mod_base = OTHER; note = uracil
tttttatattaggtattttgtaggtttatagtttttttttgagatagagtttgattttgttttttaggttggagtgtagtggygtaattttggtttattgtaattttygtttttygggtttaagttatttttttgttttagtttattaygtagttggaattatagatatttattattatgttyggttaattttttatagttttagtagagatagaggttttaaatttttgatttgaggtgatttatttattttygttttttaaagtgttgggattataggtatgagttatygygttyggt

SEQ ID NO: 123 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 7: mod_base = OTHER; note = uracil
  modified_base 8: mod_base = OTHER; note = uracil
  modified_base 14: mod_base = OTHER; note = uracil
  modified_base 16: mod_base = OTHER; note = uracil
  modified_base 20: mod_base = OTHER; note = uracil
  modified_base 26: mod_base = OTHER; note = uracil
  modified_base 29: mod_base = OTHER; note = uracil
  modified_base 31: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 43: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 60: mod_base = OTHER; note = uracil
  modified_base 66: mod_base = OTHER; note = uracil
  modified_base 90: mod_base = OTHER; note = uracil
  modified_base 97: mod_base = OTHER; note = uracil
  modified_base 101: mod_base = OTHER; note = uracil
  modified_base 111: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 154: mod_base = OTHER; note = uracil
  modified_base 157: mod_base = OTHER; note = uracil
  modified_base 158: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 180: mod_base = OTHER; note = uracil
  modified_base 188: mod_base = OTHER; note = uracil
  modified_base 195: mod_base = OTHER; note = uracil
  modified_base 197: mod_base = OTHER; note = uracil
  modified_base 199: mod_base = OTHER; note = uracil
  modified_base 204: mod_base = OTHER; note = uracil
  modified_base 205: mod_base = OTHER; note = uracil
  modified_base 214: mod_base = OTHER; note = uracil
  modified_base 216: mod_base = OTHER; note = uracil
  modified_base 226: mod_base = OTHER; note = uracil
  modified_base 228: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 259: mod_base = OTHER; note = uracil
  modified_base 261: mod_base = OTHER; note = uracil
  modified_base 271: mod_base = OTHER; note = uracil
  modified_base 279: mod_base = OTHER; note = uracil
  modified_base 280: mod_base = OTHER; note = uracil
  modified_base 284: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 299: mod_base = OTHER; note = uracil
  modified_base 300: mod_base = OTHER; note = uracil
taygtttttgttttatttttatgttttgttttgtatatttggtttygttttttagatagtaatagtagaattagtgaaagtattaaagtttttgatttttttgagaagagtatagaagaaataatgaygtaagttgttttttttttagttyggttatttaaaagggaaaggttttttgttyggtggataygtgatttatatgattttattaattattggagatgatttatattttttattttgtttttttgttttgtatataataaataatagygygattaggtattyggggttattgtt

SEQ ID NO: 124 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 18: mod_base = OTHER; note = uracil
  modified_base 19: mod_base = OTHER; note = uracil
  modified_base 28: mod_base = OTHER; note = uracil
  modified_base 45: mod_base = OTHER; note = uracil
  modified_base 50: mod_base = OTHER; note = uracil
  modified_base 58: mod_base = OTHER; note = uracil
  modified_base 77: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 99: mod_base = OTHER; note = uracil
  modified_base 108: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 123: mod_base = OTHER; note = uracil
  modified_base 130: mod_base = OTHER; note = uracil
  modified_base 131: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 148: mod_base = OTHER; note = uracil
  modified_base 153: mod_base = OTHER; note = uracil
  modified_base 165: mod_base = OTHER; note = uracil
  modified_base 168: mod_base = OTHER; note = uracil
  modified_base 175: mod_base = OTHER; note = uracil
  modified_base 183: mod_base = OTHER; note = uracil
  modified_base 186: mod_base = OTHER; note = uracil
  modified_base 191: mod_base = OTHER; note = uracil
  modified_base 193: mod_base = OTHER; note = uracil
  modified_base 196: mod_base = OTHER; note = uracil
  modified_base 198: mod_base = OTHER; note = uracil
  modified_base 207: mod_base = OTHER; note = uracil
  modified_base 213: mod_base = OTHER; note = uracil
  modified_base 221: mod_base = OTHER; note = uracil
  modified_base 225: mod_base = OTHER; note = uracil
  modified_base 227: mod_base = OTHER; note = uracil
  modified_base 233: mod_base = OTHER; note = uracil
  modified_base 236: mod_base = OTHER; note = uracil
  modified_base 242: mod_base = OTHER; note = uracil
  modified_base 246: mod_base = OTHER; note = uracil
  modified_base 259: mod_base = OTHER; note = uracil
  modified_base 260: mod_base = OTHER; note = uracil
  modified_base 268: mod_base = OTHER; note = uracil
  modified_base 273: mod_base = OTHER; note = uracil
  modified_base 278: mod_base = OTHER; note = uracil
  modified_base 291: mod_base = OTHER; note = uracil
ggtagtggtttygaatgtttggtygygttgttatttattgtgtataaggtaaaggggtagggtaaggagtgtgagttatttttagtgattaataaggttatgtgagttaygtgtttatyggatagggggttttttttttttaggtagtygagttggagagaggatagtttaygttattattttttttatgttttttttagaaagattaaagattttaatatttttattaattttgttattgttatttagaaggyggagttaggtgtatagagtagaatatgaaagtgaaataggagygtg

SEQ ID NO: 125 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 18: mod_base = OTHER; note = uracil
  modified_base 26: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 45: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 66: mod_base = OTHER; note = uracil
  modified_base 67: mod_base = OTHER; note = uracil
  modified_base 83: mod_base = OTHER; note = uracil
  modified_base 87: mod_base = OTHER; note = uracil
  modified_base 94: mod_base = OTHER; note = uracil
  modified_base 96: mod_base = OTHER; note = uracil
  modified_base 111: mod_base = OTHER; note = uracil
  modified_base 112: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 144: mod_base = OTHER; note = uracil
  modified_base 147: mod_base = OTHER; note = uracil
  modified_base 158: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 194: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 222: mod_base = OTHER; note = uracil
  modified_base 231: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 246: mod_base = OTHER; note = uracil
  modified_base 248: mod_base = OTHER; note = uracil
  modified_base 253: mod_base = OTHER; note = uracil
  modified_base 254: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 270: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 300: mod_base = OTHER; note = uracil
agttttttgggyggggttyggggagtaggttygtatttggaggatagggtgtgatttatttgaattttygttaaagtaaaagtygatygayggttttgggaggtttgaggtttggyggggyggtttygggaagtgatttgtggtygttaggygygygttggaaatttttttttatttgyggagtttatyggagttgtgatyggaggaggaatttttttaggtagggaggatygtagggttttttttattygttttgaggggttttggggtttggggagtaaatttggggtgatttatttt

SEQ ID NO: 126 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 103: mod_base = OTHER; note = uracil
  modified_base 105: mod_base = OTHER; note = uracil
  modified_base 108: mod_base = OTHER; note = uracil
  modified_base 110: mod_base = OTHER; note = uracil
  modified_base 118: mod_base = OTHER; note = uracil
  modified_base 120: mod_base = OTHER; note = uracil
  modified_base 123: mod_base = OTHER; note = uracil
  modified_base 140: mod_base = OTHER; note = uracil
  modified_base 141: mod_base = OTHER; note = uracil
  modified_base 150: mod_base = OTHER; note = uracil
  modified_base 151: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 166: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 191: mod_base = OTHER; note = uracil
  modified_base 192: mod_base = OTHER; note = uracil
  modified_base 194: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 219: mod_base = OTHER; note = uracil
  modified_base 225: mod_base = OTHER; note = uracil
  modified_base 239: mod_base = OTHER; note = uracil
  modified_base 248: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 272: mod_base = OTHER; note = uracil
  modified_base 273: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 299: mod_base = OTHER; note = uracil
gaaatgggttattttaggtttgttttttaagttttagggttttttaggaygagtgaaaaaggttttgyggttttttttgtttgggggaatttttttttygattatagtttyggtgggtttygtagatgggaaagggtttttagygygygtttagyggttataaattatttttyggggtygtttygttaggttttaaattttttagagtygtyggtyggtttttattttaaygaggatttagatgggttatattttgttttttaaatgygggtttgtttttyggatttygtttagggggtt

SEQ ID NO: 127 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 5: mod_base = OTHER; note = uracil
  modified_base 7: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 28: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 39: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 66: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 116: mod_base = OTHER; note = uracil
  modified_base 125: mod_base = OTHER; note = uracil
  modified_base 128: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 183: mod_base = OTHER; note = uracil
  modified_base 184: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 200: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 247: mod_base = OTHER; note = uracil
  modified_base 254: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 286: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 298: mod_base = OTHER; note = uracil
tatttataaattttttaggtttttttatttttttygtatagtttgttttyggtgttttagaaagattggaaatgaggtgagtttttttggatttttgtttgttatttgtaaatattatgtggtgttatttgtttttttgttttttttttygttttaggttaatttttttatttttttaattgttyggggatttttattatttaaatttttttattggtatttttttttttatataagtttttttagttgtttttygtttttaattaatattttttttggttttagttattgttattttat

SEQ ID NO: 128 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 16: mod_base = OTHER; note = uracil
  modified_base 22: mod_base = OTHER; note = uracil
  modified_base 23: mod_base = OTHER; note = uracil
  modified_base 52: mod_base = OTHER; note = uracil
  modified_base 55: mod_base = OTHER; note = uracil
  modified_base 64: mod_base = OTHER; note = uracil
  modified_base 84: mod_base = OTHER; note = uracil
  modified_base 85: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 119: mod_base = OTHER; note = uracil
  modified_base 143: mod_base = OTHER; note = uracil
  modified_base 144: mod_base = OTHER; note = uracil
  modified_base 162: mod_base = OTHER; note = uracil
  modified_base 170: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 193: mod_base = OTHER; note = uracil
  modified_base 200: mod_base = OTHER; note = uracil
  modified_base 204: mod_base = OTHER; note = uracil
  modified_base 211: mod_base = OTHER; note = uracil
  modified_base 212: mod_base = OTHER; note = uracil
  modified_base 220: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 232: mod_base = OTHER; note = uracil
  modified_base 233: mod_base = OTHER; note = uracil
  modified_base 237: mod_base = OTHER; note = uracil
  modified_base 241: mod_base = OTHER; note = uracil
  modified_base 247: mod_base = OTHER; note = uracil
  modified_base 249: mod_base = OTHER; note = uracil
  modified_base 256: mod_base = OTHER; note = uracil
  modified_base 260: mod_base = OTHER; note = uracil
  modified_base 282: mod_base = OTHER; note = uracil
  modified_base 283: mod_base = OTHER; note = uracil
atgaagtggtagtagttggagttagggaaggtgttggttaaagayggaaaatagttgaggaggtttgtgtgggaggagaggtattagtggaaaggtttaagtaatggagattttygggtaattaagggggtgggaggattggtttgggaygggaggagggataggagggtaagtagtattatatgatatttgtaggtggtaggtagggatttaagggagtttattttatttttagtttttttggagtatyggaggtagattgtgygggaagagtgagggggtttgggaggtttgtggatg

SEQ ID NO: 129 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 36: mod_base = OTHER; note = uracil
  modified_base 44: mod_base = OTHER; note = uracil
  modified_base 46: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 75: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 122: mod_base = OTHER; note = uracil
  modified_base 125: mod_base = OTHER; note = uracil
  modified_base 132: mod_base = OTHER; note = uracil
  modified_base 139: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 149: mod_base = OTHER; note = uracil
  modified_base 154: mod_base = OTHER; note = uracil
  modified_base 160: mod_base = OTHER; note = uracil
  modified_base 162: mod_base = OTHER; note = uracil
  modified_base 167: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 178: mod_base = OTHER; note = uracil
  modified_base 192: mod_base = OTHER; note = uracil
  modified_base 212: mod_base = OTHER; note = uracil
  modified_base 214: mod_base = OTHER; note = uracil
  modified_base 225: mod_base = OTHER; note = uracil
  modified_base 248: mod_base = OTHER; note = uracil
  modified_base 253: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 273: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 289: mod_base = OTHER; note = uracil
  modified_base 293: mod_base = OTHER; note = uracil
  modified_base 295: mod_base = OTHER; note = uracil
  modified_base 297: mod_base = OTHER; note = uracil
tttttttaggattgttttggttttttggttttagtttggaggatttttgtttatttttttygtttttaggtgagttgagaatttattgygygygggattttgttgygtttgttttttygggttgtagagggtaggaygtatygttaggtaaggtygyggttttgygttgatgttatttygggagygggtggttgygggggaggagggygagtattggaygggggtagyggagtgtagggtgtgagatttaaatagagggttttattggagggtttgtttagaaggyggtagttatattgg

SEQ ID NO: 130 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 10: mod_base = OTHER; note = uracil
  modified_base 13: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 56: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 69: mod_base = OTHER; note = uracil
  modified_base 71: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 84: mod_base = OTHER; note = uracil
  modified_base 85: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 129: mod_base = OTHER; note = uracil
  modified_base 132: mod_base = OTHER; note = uracil
  modified_base 137: mod_base = OTHER; note = uracil
  modified_base 142: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 154: mod_base = OTHER; note = uracil
  modified_base 166: mod_base = OTHER; note = uracil
  modified_base 167: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 177: mod_base = OTHER; note = uracil
  modified_base 180: mod_base = OTHER; note = uracil
  modified_base 181: mod_base = OTHER; note = uracil
  modified_base 190: mod_base = OTHER; note = uracil
  modified_base 196: mod_base = OTHER; note = uracil
  modified_base 199: mod_base = OTHER; note = uracil
  modified_base 205: mod_base = OTHER; note = uracil
  modified_base 206: mod_base = OTHER; note = uracil
  modified_base 213: mod_base = OTHER; note = uracil
  modified_base 222: mod_base = OTHER; note = uracil
  modified_base 224: mod_base = OTHER; note = uracil
  modified_base 227: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 252: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 267: mod_base = OTHER; note = uracil
  modified_base 273: mod_base = OTHER; note = uracil
  modified_base 274: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 291: mod_base = OTHER; note = uracil
  modified_base 292: mod_base = OTHER; note = uracil
ttagtgtgattgtygttttttgggtaagttttttagtggagttttttgtttagattttatattttatatttygttgttttygtttagtgttygtttttttttttygtagttattygttttyggagtggtattagygtagagtygyggttttgtttggyggtgygttttgttttttgtagttygggagggtaggygtagtagagtttygygygtagtgggtttttagtttatttgggggyggaggaagtgagtaagagttttttagattggggttagggggttaaggtagttttgggaaag

SEQ ID NO: 131 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 11: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 19: mod_base = OTHER; note = uracil
  modified_base 20: mod_base = OTHER; note = uracil
  modified_base 22: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 54: mod_base = OTHER; note = uracil
  modified_base 58: mod_base = OTHER; note = uracil
  modified_base 60: mod_base = OTHER; note = uracil
  modified_base 61: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 77: mod_base = OTHER; note = uracil
  modified_base 78: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 103: mod_base = OTHER; note = uracil
  modified_base 106: mod_base = OTHER; note = uracil
  modified_base 110: mod_base = OTHER; note = uracil
  modified_base 112: mod_base = OTHER; note = uracil
  modified_base 116: mod_base = OTHER; note = uracil
  modified_base 118: mod_base = OTHER; note = uracil
  modified_base 120: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 132: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 150: mod_base = OTHER; note = uracil
  modified_base 160: mod_base = OTHER; note = uracil
  modified_base 164: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 176: mod_base = OTHER; note = uracil
  modified_base 180: mod_base = OTHER; note = uracil
  modified_base 182: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 208: mod_base = OTHER; note = uracil
  modified_base 222: mod_base = OTHER; note = uracil
  modified_base 224: mod_base = OTHER; note = uracil
  modified_base 227: mod_base = OTHER; note = uracil
  modified_base 230: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 242: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 255: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 296: mod_base = OTHER; note = uracil
  modified_base 300: mod_base = OTHER; note = uracil
tttagggtttttttttygtttttttttttttttygttttttttttttttgyggttgattttagttttttttyggtgttygtaattttttttttttttttttgtygtagttttygttttttttttatagggttttttttttttttttttttygtggttgttagatttttttttggatttttttygtttygtatygttygtttyggatgtygagygtggtagattttgtagtygggtttttygttgttygttggygttgtttatatttttttgggtttttttttaaggtttttttygttygt

SEQ ID NO: 132 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 16: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 44: mod_base = OTHER; note = uracil
  modified_base 49: mod_base = OTHER; note = uracil
  modified_base 50: mod_base = OTHER; note = uracil
  modified_base 57: mod_base = OTHER; note = uracil
  modified_base 67: mod_base = OTHER; note = uracil
  modified_base 68: mod_base = OTHER; note = uracil
  modified_base 72: mod_base = OTHER; note = uracil
  modified_base 75: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 94: mod_base = OTHER; note = uracil
  modified_base 97: mod_base = OTHER; note = uracil
  modified_base 127: mod_base = OTHER; note = uracil
  modified_base 128: mod_base = OTHER; note = uracil
  modified_base 139: mod_base = OTHER; note = uracil
  modified_base 143: mod_base = OTHER; note = uracil
  modified_base 146: mod_base = OTHER; note = uracil
  modified_base 147: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 193: mod_base = OTHER; note = uracil
  modified_base 199: mod_base = OTHER; note = uracil
  modified_base 225: mod_base = OTHER; note = uracil
  modified_base 227: mod_base = OTHER; note = uracil
  modified_base 238: mod_base = OTHER; note = uracil
  modified_base 245: mod_base = OTHER; note = uracil
  modified_base 248: mod_base = OTHER; note = uracil
  modified_base 251: mod_base = OTHER; note = uracil
  modified_base 294: mod_base = OTHER; note = uracil
  modified_base 295: mod_base = OTHER; note = uracil
  modified_base 296: mod_base = OTHER; note = uracil
gygagyggaggggattttggaggggagtttaagggggtgtaggtagygttagygggtagygaggagttyggttgtagagtttattaygttyggtattyggggygggyggtgyggggyggagaaagtttaggagaaagtttgataattayggggagagggggagggagagattttgtggaagagagayggagattgyggtaaaaagaggaaaggagggttaygggtatygagggggagttggagttagtygtaaggagagagggagygggggaggaaaagaggygggagagagattttaaa

SEQ ID NO: 133 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 9: mod_base = OTHER; note = uracil
  modified_base 16: mod_base = OTHER; note = uracil
  modified_base 21: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 59: mod_base = OTHER; note = uracil
  modified_base 61: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 93: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 112: mod_base = OTHER; note = uracil
  modified_base 117: mod_base = OTHER; note = uracil
  modified_base 126: mod_base = OTHER; note = uracil
  modified_base 128: mod_base = OTHER; note = uracil
  modified_base 134: mod_base = OTHER; note = uracil
  modified_base 138: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 167: mod_base = OTHER; note = uracil
  modified_base 170: mod_base = OTHER; note = uracil
  modified_base 173: mod_base = OTHER; note = uracil
  modified_base 175: mod_base = OTHER; note = uracil
  modified_base 179: mod_base = OTHER; note = uracil
  modified_base 185: mod_base = OTHER; note = uracil
  modified_base 187: mod_base = OTHER; note = uracil
  modified_base 191: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 208: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 221: mod_base = OTHER; note = uracil
  modified_base 222: mod_base = OTHER; note = uracil
  modified_base 230: mod_base = OTHER; note = uracil
  modified_base 233: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 268: mod_base = OTHER; note = uracil
  modified_base 275: mod_base = OTHER; note = uracil
  modified_base 276: mod_base = OTHER; note = uracil
  modified_base 279: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 299: mod_base = OTHER; note = uracil
  modified_base 300: mod_base = OTHER; note = uracil
gagggttatagtaaattggataagtttttttgtttagtttaggttgttatttgtaggttatttgggttttagttatgtggttgttttttttgttgggtgttttattttgggtagtgttgtggttgtttagggatyggtagagtttgttygttagtaatgtttttgtttttattatyggttgtgatttaggttttgggygttttttggtattgtagttggattagagaggttttygagttttggttagttgtttgatttttttyggggtygaggatttgtagygggtggttttttttygtt

SEQ ID NO: 134 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 19: mod_base = OTHER; note = uracil
  modified_base 22: mod_base = OTHER; note = uracil
  modified_base 27: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 46: mod_base = OTHER; note = uracil
  modified_base 50: mod_base = OTHER; note = uracil
  modified_base 53: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 88: mod_base = OTHER; note = uracil
  modified_base 93: mod_base = OTHER; note = uracil
  modified_base 94: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 110: mod_base = OTHER; note = uracil
  modified_base 111: mod_base = OTHER; note = uracil
  modified_base 117: mod_base = OTHER; note = uracil
  modified_base 119: mod_base = OTHER; note = uracil
  modified_base 122: mod_base = OTHER; note = uracil
  modified_base 135: mod_base = OTHER; note = uracil
  modified_base 141: mod_base = OTHER; note = uracil
  modified_base 146: mod_base = OTHER; note = uracil
  modified_base 154: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 228: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 244: mod_base = OTHER; note = uracil
  modified_base 247: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 263: mod_base = OTHER; note = uracil
  modified_base 268: mod_base = OTHER; note = uracil
  modified_base 276: mod_base = OTHER; note = uracil
  modified_base 281: mod_base = OTHER; note = uracil
  modified_base 282: mod_base = OTHER; note = uracil
  modified_base 289: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 299: mod_base = OTHER; note = uracil
gygggaggaggttattygttgtaggttttyggtttyggagggggttaggtagttggttaggattyggaagtttttttggtttagttgtagtgttagaaggygtttaaagtttgagttatagtyggtgatgaagataaaggtattgttggygggtaggttttgtyggtttttgagtaattatagtattgtttagagtaaggtatttagtagaagaggtagttatatagttggagtttaagtgatttataggtggtagtttaggttgggtagaaaaatttgtttagtttattgtggttttta

SEQ ID NO: 135 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 8: mod_base = OTHER; note = uracil
  modified_base 11: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 32: mod_base = OTHER; note = uracil
  modified_base 33: mod_base = OTHER; note = uracil
  modified_base 39: mod_base = OTHER; note = uracil
  modified_base 47: mod_base = OTHER; note = uracil
  modified_base 56: mod_base = OTHER; note = uracil
  modified_base 61: mod_base = OTHER; note = uracil
  modified_base 66: mod_base = OTHER; note = uracil
  modified_base 73: mod_base = OTHER; note = uracil
  modified_base 76: mod_base = OTHER; note = uracil
  modified_base 83: mod_base = OTHER; note = uracil
  modified_base 98: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 120: mod_base = OTHER; note = uracil
  modified_base 128: mod_base = OTHER; note = uracil
  modified_base 131: mod_base = OTHER; note = uracil
  modified_base 132: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 164: mod_base = OTHER; note = uracil
  modified_base 171: mod_base = OTHER; note = uracil
  modified_base 173: mod_base = OTHER; note = uracil
  modified_base 175: mod_base = OTHER; note = uracil
  modified_base 180: mod_base = OTHER; note = uracil
  modified_base 185: mod_base = OTHER; note = uracil
  modified_base 191: mod_base = OTHER; note = uracil
  modified_base 194: mod_base = OTHER; note = uracil
  modified_base 203: mod_base = OTHER; note = uracil
  modified_base 217: mod_base = OTHER; note = uracil
  modified_base 223: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 285: mod_base = OTHER; note = uracil
  modified_base 294: mod_base = OTHER; note = uracil
gttttggttttatttttttttttttaaaatgttatttttatttgtttttagagtttagaatatgttaaagagtttttttaagtagtaggtggttttatagagtttatagagaaggaaaattaaatattatttyggatgtagtttattaygatygtggaggagttagattatttttygggttttgttgtgtttgtttgtgaaataggaaagggagaattgaggtaatgagttattttatttgggtttaaagtattatttaygttgaatatggagaaaatgtgaagtaagagttttttttta

SEQ ID NO: 136 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 13: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 37: mod_base = OTHER; note = uracil
  modified_base 51: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 72: mod_base = OTHER; note = uracil
  modified_base 74: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 102: mod_base = OTHER; note = uracil
  modified_base 104: mod_base = OTHER; note = uracil
  modified_base 108: mod_base = OTHER; note = uracil
  modified_base 112: mod_base = OTHER; note = uracil
  modified_base 114: mod_base = OTHER; note = uracil
  modified_base 117: mod_base = OTHER; note = uracil
  modified_base 122: mod_base = OTHER; note = uracil
  modified_base 123: mod_base = OTHER; note = uracil
  modified_base 135: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 160: mod_base = OTHER; note = uracil
  modified_base 163: mod_base = OTHER; note = uracil
  modified_base 166: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 192: mod_base = OTHER; note = uracil
  modified_base 199: mod_base = OTHER; note = uracil
  modified_base 201: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 219: mod_base = OTHER; note = uracil
  modified_base 229: mod_base = OTHER; note = uracil
  modified_base 231: mod_base = OTHER; note = uracil
  modified_base 237: mod_base = OTHER; note = uracil
  modified_base 243: mod_base = OTHER; note = uracil
  modified_base 248: mod_base = OTHER; note = uracil
  modified_base 250: mod_base = OTHER; note = uracil
  modified_base 257: mod_base = OTHER; note = uracil
  modified_base 270: mod_base = OTHER; note = uracil
  modified_base 294: mod_base = OTHER; note = uracil
  modified_base 295: mod_base = OTHER; note = uracil
  modified_base 300: mod_base = OTHER; note = uracil
taaaaagaaatttttgttttatattttttttatatttaaygtaggtggtgttttgggtttaagtgaggtgatttattgttttagtttttttttttttgttttataagtagatatagtaaagttyggagagtaatttgatttttttaygatygtagtggattgtattygggatgatatttagttttttttttttgtgggttttgtaaaattatttattgtttaaagaagttttttgatatgttttgaattttaagaataaatgaaaatggtattttgggaaaaaaaaaatgaagttagaat

SEQ ID NO: 137 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 4: mod_base = OTHER; note = uracil
  modified_base 5: mod_base = OTHER; note = uracil
  modified_base 7: mod_base = OTHER; note = uracil
  modified_base 8: mod_base = OTHER; note = uracil
  modified_base 12: mod_base = OTHER; note = uracil
  modified_base 17: mod_base = OTHER; note = uracil
  modified_base 25: mod_base = OTHER; note = uracil
  modified_base 26: mod_base = OTHER; note = uracil
  modified_base 30: mod_base = OTHER; note = uracil
  modified_base 37: mod_base = OTHER; note = uracil
  modified_base 38: mod_base = OTHER; note = uracil
  modified_base 43: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 66: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 89: mod_base = OTHER; note = uracil
  modified_base 91: mod_base = OTHER; note = uracil
  modified_base 96: mod_base = OTHER; note = uracil
  modified_base 104: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 114: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 136: mod_base = OTHER; note = uracil
  modified_base 138: mod_base = OTHER; note = uracil
  modified_base 145: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 177: mod_base = OTHER; note = uracil
  modified_base 191: mod_base = OTHER; note = uracil
  modified_base 196: mod_base = OTHER; note = uracil
  modified_base 203: mod_base = OTHER; note = uracil
  modified_base 209: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 236: mod_base = OTHER; note = uracil
  modified_base 241: mod_base = OTHER; note = uracil
  modified_base 253: mod_base = OTHER; note = uracil
  modified_base 259: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 272: mod_base = OTHER; note = uracil
  modified_base 273: mod_base = OTHER; note = uracil
  modified_base 277: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 292: mod_base = OTHER; note = uracil
  modified_base 295: mod_base = OTHER; note = uracil
ttttttttagtttttgtatatatattaggttggtatttattgtaggtggggattttttttttgggttttggagtttttttttttgtgtttttgtatyggggagttttttttttttgttttttttttttttttttgtttattaaatttttygttttttaaaattattttaygtgtgttygtgttgttttatttaaatyggyggtaggattaagaatttttgtgtttttgtatttattagagtygtatgataattaagagttgattatttgggttatttttatattattagtgtygtattta

SEQ ID NO: 138 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 12: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 40: mod_base = OTHER; note = uracil
  modified_base 43: mod_base = OTHER; note = uracil
  modified_base 45: mod_base = OTHER; note = uracil
  modified_base 54: mod_base = OTHER; note = uracil
  modified_base 61: mod_base = OTHER; note = uracil
  modified_base 63: mod_base = OTHER; note = uracil
  modified_base 73: mod_base = OTHER; note = uracil
  modified_base 79: mod_base = OTHER; note = uracil
  modified_base 81: mod_base = OTHER; note = uracil
  modified_base 89: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 102: mod_base = OTHER; note = uracil
  modified_base 117: mod_base = OTHER; note = uracil
  modified_base 120: mod_base = OTHER; note = uracil
  modified_base 126: mod_base = OTHER; note = uracil
  modified_base 128: mod_base = OTHER; note = uracil
  modified_base 166: mod_base = OTHER; note = uracil
  modified_base 185: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 208: mod_base = OTHER; note = uracil
  modified_base 214: mod_base = OTHER; note = uracil
  modified_base 216: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 285: mod_base = OTHER; note = uracil
  modified_base 291: mod_base = OTHER; note = uracil
taaatgyggtattaatggtatgagaatggtttaggtagttagtttttgattattatayggttttgatgagtgtaggaatataagggtttttgattttgtygtyggtttagataaaataatayggatataygtggagtggttttaaggagyggagagtttaatgagtaagaaggaagggagaagatagaaggaagaagtttttyggtatagagatatagggaggggggttttaaagtttaaagaggaggtttttatttgtaatggatattagtttggtatatatgtaaagattggaggagg

SEQ ID NO: 139 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 17: mod_base = OTHER; note = uracil
  modified_base 22: mod_base = OTHER; note = uracil
  modified_base 23: mod_base = OTHER; note = uracil
  modified_base 28: mod_base = OTHER; note = uracil
  modified_base 33: mod_base = OTHER; note = uracil
  modified_base 50: mod_base = OTHER; note = uracil
  modified_base 56: mod_base = OTHER; note = uracil
  modified_base 59: mod_base = OTHER; note = uracil
  modified_base 76: mod_base = OTHER; note = uracil
  modified_base 79: mod_base = OTHER; note = uracil
  modified_base 85: mod_base = OTHER; note = uracil
  modified_base 87: mod_base = OTHER; note = uracil
  modified_base 95: mod_base = OTHER; note = uracil
  modified_base 96: mod_base = OTHER; note = uracil
  modified_base 103: mod_base = OTHER; note = uracil
  modified_base 105: mod_base = OTHER; note = uracil
  modified_base 111: mod_base = OTHER; note = uracil
  modified_base 112: mod_base = OTHER; note = uracil
  modified_base 114: mod_base = OTHER; note = uracil
  modified_base 115: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 128: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 145: mod_base = OTHER; note = uracil
  modified_base 147: mod_base = OTHER; note = uracil
  modified_base 151: mod_base = OTHER; note = uracil
  modified_base 159: mod_base = OTHER; note = uracil
  modified_base 160: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 178: mod_base = OTHER; note = uracil
  modified_base 188: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 221: mod_base = OTHER; note = uracil
  modified_base 227: mod_base = OTHER; note = uracil
  modified_base 228: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 264: mod_base = OTHER; note = uracil
  modified_base 280: mod_base = OTHER; note = uracil
  modified_base 282: mod_base = OTHER; note = uracil
  modified_base 292: mod_base = OTHER; note = uracil
  modified_base 299: mod_base = OTHER; note = uracil
aaggttaaagtygttgttagattaaggttaaatygtggygaggtagttgtttgygtygtagagtgtgggtgtgaatagttggagtttagtggtttttggagatttagggattatttgtattttatattyggttttttatttaygtataygtagtatgatttgggttttttttttatatagtggaatgttaagtgtttatattttagtyggggttagttaattatggtttgtgggtattattttatttgtagtttgtttttgagttaagaatgttgttgatatttttaaaaatagagaata

SEQ ID NO: 140 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 22: mod_base = OTHER; note = uracil
  modified_base 25: mod_base = OTHER; note = uracil
  modified_base 28: mod_base = OTHER; note = uracil
  modified_base 32: mod_base = OTHER; note = uracil
  modified_base 37: mod_base = OTHER; note = uracil
  modified_base 39: mod_base = OTHER; note = uracil
  modified_base 45: mod_base = OTHER; note = uracil
  modified_base 49: mod_base = OTHER; note = uracil
  modified_base 52: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 84: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 106: mod_base = OTHER; note = uracil
  modified_base 108: mod_base = OTHER; note = uracil
  modified_base 113: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 143: mod_base = OTHER; note = uracil
  modified_base 147: mod_base = OTHER; note = uracil
  modified_base 169: mod_base = OTHER; note = uracil
  modified_base 183: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 227: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 237: mod_base = OTHER; note = uracil
  modified_base 239: mod_base = OTHER; note = uracil
  modified_base 247: mod_base = OTHER; note = uracil
  modified_base 251: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 263: mod_base = OTHER; note = uracil
  modified_base 273: mod_base = OTHER; note = uracil
  modified_base 274: mod_base = OTHER; note = uracil
  modified_base 280: mod_base = OTHER; note = uracil
  modified_base 284: mod_base = OTHER; note = uracil
  modified_base 290: mod_base = OTHER; note = uracil
  modified_base 296: mod_base = OTHER; note = uracil
  modified_base 297: mod_base = OTHER; note = uracil
gttttttgtttttaaaagtgttaataatatttttagtttaaaaataggttgtaggtgggatggtgtttataggttatagttggttgatttyggttagggtgtaggtatttagtattttattgtataaaggggaaatttaggttatattgygtgtgygtgggtgggaagtyggatgtggaatataggtggtttttgagtttttaggaattattgagttttagttgtttatatttatattttgyggygtaagtaattatttygttayggtttagttttggtttagtagygattttaattttg

SEQ ID NO: 141 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 18: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 30: mod_base = OTHER; note = uracil
  modified_base 38: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 91: mod_base = OTHER; note = uracil
  modified_base 97: mod_base = OTHER; note = uracil
  modified_base 100: mod_base = OTHER; note = uracil
  modified_base 104: mod_base = OTHER; note = uracil
  modified_base 106: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 160: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 174: mod_base = OTHER; note = uracil
  modified_base 179: mod_base = OTHER; note = uracil
  modified_base 181: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 193: mod_base = OTHER; note = uracil
  modified_base 195: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 228: mod_base = OTHER; note = uracil
  modified_base 237: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 250: mod_base = OTHER; note = uracil
  modified_base 256: mod_base = OTHER; note = uracil
  modified_base 260: mod_base = OTHER; note = uracil
  modified_base 285: mod_base = OTHER; note = uracil
  modified_base 290: mod_base = OTHER; note = uracil
  modified_base 291: mod_base = OTHER; note = uracil
  modified_base 295: mod_base = OTHER; note = uracil
  modified_base 296: mod_base = OTHER; note = uracil
  modified_base 298: mod_base = OTHER; note = uracil
gagatagggttttatttttgtygtttaggttggagtgtagttttaattttttgggtttagtggatttttttattttagatttttgagtagtygggattataggtataygttattaggtttagttaattttttgtatttttttgtagagaygaggtttygttaggttgtttaggttggtttttaatttttgggtttaagygatttatttattttagttttttaaagtgttggggttataggtttgagttatagygttyggttgaaagtgaagttgaatgagatgattygtttaggttatat

SEQ ID NO: 142 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 18: mod_base = OTHER; note = uracil
  modified_base 21: mod_base = OTHER; note = uracil
  modified_base 23: mod_base = OTHER; note = uracil
  modified_base 27: mod_base = OTHER; note = uracil
  modified_base 30: mod_base = OTHER; note = uracil
  modified_base 33: mod_base = OTHER; note = uracil
  modified_base 35: mod_base = OTHER; note = uracil
  modified_base 39: mod_base = OTHER; note = uracil
  modified_base 42: mod_base = OTHER; note = uracil
  modified_base 49: mod_base = OTHER; note = uracil
  modified_base 55: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 86: mod_base = OTHER; note = uracil
  modified_base 103: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 134: mod_base = OTHER; note = uracil
  modified_base 137: mod_base = OTHER; note = uracil
  modified_base 138: mod_base = OTHER; note = uracil
  modified_base 147: mod_base = OTHER; note = uracil
  modified_base 148: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 168: mod_base = OTHER; note = uracil
  modified_base 179: mod_base = OTHER; note = uracil
  modified_base 184: mod_base = OTHER; note = uracil
  modified_base 185: mod_base = OTHER; note = uracil
  modified_base 198: mod_base = OTHER; note = uracil
  modified_base 199: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 214: mod_base = OTHER; note = uracil
  modified_base 216: mod_base = OTHER; note = uracil
  modified_base 223: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 261: mod_base = OTHER; note = uracil
  modified_base 264: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 281: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 298: mod_base = OTHER; note = uracil
  modified_base 300: mod_base = OTHER; note = uracil
atgtggtttggaygagttattttatttaattttatttttagtyggaygttgtgatttaggtttgtaattttagtattttgggaagttgaggtgggtggatygtttgagtttaggagttagagattagtttgggtaatttagygaaatttygtttttataaaaaaatataaaaaattagttaggtttggtggygtgtgtttgtagtttyggttatttaggagtttgaggtgggaagatttattgagtttaggaggttgaggttgtattttagtttgggygataggagtgaaattttgtttt

SEQ ID NO: 143 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 19: mod_base = OTHER; note = uracil
  modified_base 56: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 70: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 91: mod_base = OTHER; note = uracil
  modified_base 99: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 124: mod_base = OTHER; note = uracil
  modified_base 133: mod_base = OTHER; note = uracil
  modified_base 137: mod_base = OTHER; note = uracil
  modified_base 138: mod_base = OTHER; note = uracil
  modified_base 144: mod_base = OTHER; note = uracil
  modified_base 146: mod_base = OTHER; note = uracil
  modified_base 152: mod_base = OTHER; note = uracil
  modified_base 156: mod_base = OTHER; note = uracil
  modified_base 181: mod_base = OTHER; note = uracil
  modified_base 186: mod_base = OTHER; note = uracil
  modified_base 187: mod_base = OTHER; note = uracil
  modified_base 191: mod_base = OTHER; note = uracil
  modified_base 192: mod_base = OTHER; note = uracil
  modified_base 194: mod_base = OTHER; note = uracil
  modified_base 199: mod_base = OTHER; note = uracil
  modified_base 203: mod_base = OTHER; note = uracil
  modified_base 209: mod_base = OTHER; note = uracil
  modified_base 219: mod_base = OTHER; note = uracil
  modified_base 220: mod_base = OTHER; note = uracil
  modified_base 232: mod_base = OTHER; note = uracil
  modified_base 236: mod_base = OTHER; note = uracil
  modified_base 239: mod_base = OTHER; note = uracil
  modified_base 241: mod_base = OTHER; note = uracil
  modified_base 250: mod_base = OTHER; note = uracil
  modified_base 256: mod_base = OTHER; note = uracil
  modified_base 257: mod_base = OTHER; note = uracil
  modified_base 263: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 284: mod_base = OTHER; note = uracil
  modified_base 289: mod_base = OTHER; note = uracil
  modified_base 295: mod_base = OTHER; note = uracil
  modified_base 296: mod_base = OTHER; note = uracil
  modified_base 300: mod_base = OTHER; note = uracil
ataygttattaggtttagttaattttttgtatttttttgtagagaygaggtttygttaggttgtttaggttggtttttaatttttgggtttaagygatttatttattttagttttttaaagtgttggggttataggtttgagttatagygttyggttgaaagtgaagttgaatgagatgattygtttaggttatatggtaattagtggttgattgaygttaaagttgattttattttttttaatgggtttagagtttaaattttggaattttagaagaygttgttattttggttttaagt

SEQ ID NO: 144 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 9: mod_base = OTHER; note = uracil
  modified_base 17: mod_base = OTHER; note = uracil
  modified_base 23: mod_base = OTHER; note = uracil
  modified_base 26: mod_base = OTHER; note = uracil
  modified_base 34: mod_base = OTHER; note = uracil
  modified_base 35: mod_base = OTHER; note = uracil
  modified_base 46: mod_base = OTHER; note = uracil
  modified_base 48: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 73: mod_base = OTHER; note = uracil
  modified_base 76: mod_base = OTHER; note = uracil
  modified_base 85: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 102: mod_base = OTHER; note = uracil
  modified_base 103: mod_base = OTHER; note = uracil
  modified_base 110: mod_base = OTHER; note = uracil
  modified_base 111: mod_base = OTHER; note = uracil
  modified_base 121: mod_base = OTHER; note = uracil
  modified_base 124: mod_base = OTHER; note = uracil
  modified_base 126: mod_base = OTHER; note = uracil
  modified_base 130: mod_base = OTHER; note = uracil
  modified_base 133: mod_base = OTHER; note = uracil
  modified_base 136: mod_base = OTHER; note = uracil
  modified_base 138: mod_base = OTHER; note = uracil
  modified_base 142: mod_base = OTHER; note = uracil
  modified_base 145: mod_base = OTHER; note = uracil
  modified_base 152: mod_base = OTHER; note = uracil
  modified_base 158: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 179: mod_base = OTHER; note = uracil
  modified_base 189: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 227: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 250: mod_base = OTHER; note = uracil
  modified_base 251: mod_base = OTHER; note = uracil
  modified_base 256: mod_base = OTHER; note = uracil
  modified_base 258: mod_base = OTHER; note = uracil
  modified_base 261: mod_base = OTHER; note = uracil
  modified_base 271: mod_base = OTHER; note = uracil
  modified_base 282: mod_base = OTHER; note = uracil
  modified_base 287: mod_base = OTHER; note = uracil
  modified_base 288: mod_base = OTHER; note = uracil
tttggaattagaatagtaaygttttttgaggttttagaatttggattttgaatttattgagaagaatgaaattaattttggygttaattagttattgattgttatgtggtttggaygagttattttatttaattttatttttagtyggaygttgtgatttaggtttgtaattttagtattttgggaagttgaggtgggtggatygtttgagtttaggagttagagattagtttgggtaatttagygaaatttygtttttataaaaaaatataaaaaattagttaggtttggtggygtgtg

SEQ ID NO: 145 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 15: mod_base = OTHER; note = uracil
  modified_base 19: mod_base = OTHER; note = uracil
  modified_base 20: mod_base = OTHER; note = uracil
  modified_base 24: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 36: mod_base = OTHER; note = uracil
  modified_base 41: mod_base = OTHER; note = uracil
  modified_base 45: mod_base = OTHER; note = uracil
  modified_base 50: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 66: mod_base = OTHER; note = uracil
  modified_base 71: mod_base = OTHER; note = uracil
  modified_base 84: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 98: mod_base = OTHER; note = uracil
  modified_base 100: mod_base = OTHER; note = uracil
  modified_base 108: mod_base = OTHER; note = uracil
  modified_base 113: mod_base = OTHER; note = uracil
  modified_base 119: mod_base = OTHER; note = uracil
  modified_base 123: mod_base = OTHER; note = uracil
  modified_base 127: mod_base = OTHER; note = uracil
  modified_base 131: mod_base = OTHER; note = uracil
  modified_base 138: mod_base = OTHER; note = uracil
  modified_base 139: mod_base = OTHER; note = uracil
  modified_base 142: mod_base = OTHER; note = uracil
  modified_base 158: mod_base = OTHER; note = uracil
  modified_base 165: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 180: mod_base = OTHER; note = uracil
  modified_base 181: mod_base = OTHER; note = uracil
  modified_base 189: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 226: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 242: mod_base = OTHER; note = uracil
  modified_base 251: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 262: mod_base = OTHER; note = uracil
  modified_base 266: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 289: mod_base = OTHER; note = uracil
  modified_base 293: mod_base = OTHER; note = uracil
  modified_base 295: mod_base = OTHER; note = uracil
  modified_base 297: mod_base = OTHER; note = uracil
  modified_base 298: mod_base = OTHER; note = uracil
agtgattgtagygttaggttaagtttggttatttatatgtttggtatgatagtggttttagagtattygtttgagaagaagagttattatttgagygttttggagaatttagtyggagtttttaggtagtttgggagtttatatggaggygtgtaggtttatgttttatgtttaygttgttygggagataaaatttttttttatttagagttgttttaaaatgttttgtattagttttttattgyggtggttttattttagtatataggtatgtggayggttattgtgttggtttatttt

SEQ ID NO: 146 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 13: mod_base = OTHER; note = uracil
  modified_base 15: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 40: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 67: mod_base = OTHER; note = uracil
  modified_base 73: mod_base = OTHER; note = uracil
  modified_base 78: mod_base = OTHER; note = uracil
  modified_base 88: mod_base = OTHER; note = uracil
  modified_base 91: mod_base = OTHER; note = uracil
  modified_base 93: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 122: mod_base = OTHER; note = uracil
  modified_base 131: mod_base = OTHER; note = uracil
  modified_base 138: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 183: mod_base = OTHER; note = uracil
  modified_base 185: mod_base = OTHER; note = uracil
  modified_base 189: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 206: mod_base = OTHER; note = uracil
  modified_base 208: mod_base = OTHER; note = uracil
  modified_base 218: mod_base = OTHER; note = uracil
  modified_base 220: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 238: mod_base = OTHER; note = uracil
  modified_base 240: mod_base = OTHER; note = uracil
  modified_base 246: mod_base = OTHER; note = uracil
  modified_base 247: mod_base = OTHER; note = uracil
  modified_base 249: mod_base = OTHER; note = uracil
  modified_base 253: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 273: mod_base = OTHER; note = uracil
  modified_base 274: mod_base = OTHER; note = uracil
  modified_base 278: mod_base = OTHER; note = uracil
  modified_base 283: mod_base = OTHER; note = uracil
  modified_base 284: mod_base = OTHER; note = uracil
  modified_base 290: mod_base = OTHER; note = uracil
  modified_base 293: mod_base = OTHER; note = uracil
  modified_base 297: mod_base = OTHER; note = uracil
  modified_base 299: mod_base = OTHER; note = uracil
aaggtgagttagtatagtggtygtttatatatttgtatgttaaggtgaagttatygtagtgagaagttggtgtagaatattttggggtagttttaaatagaaaaggattttgtttttygggtaaygtggatatgagatataagtttataygtttttatgtaggtttttagattgtttgaaagtttyggttaagttttttagagygtttaggtgatagtttttttttttagaygagtattttgaggttattgttatgttagatatgtaagtggttaagtttggtttgaygttgtagttatt

SEQ ID NO: 147 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 7: mod_base = OTHER; note = uracil
  modified_base 8: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 29: mod_base = OTHER; note = uracil
  modified_base 32: mod_base = OTHER; note = uracil
  modified_base 33: mod_base = OTHER; note = uracil
  modified_base 48: mod_base = OTHER; note = uracil
  modified_base 56: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 86: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 107: mod_base = OTHER; note = uracil
  modified_base 110: mod_base = OTHER; note = uracil
  modified_base 115: mod_base = OTHER; note = uracil
  modified_base 117: mod_base = OTHER; note = uracil
  modified_base 128: mod_base = OTHER; note = uracil
  modified_base 144: mod_base = OTHER; note = uracil
  modified_base 145: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 189: mod_base = OTHER; note = uracil
  modified_base 191: mod_base = OTHER; note = uracil
  modified_base 194: mod_base = OTHER; note = uracil
  modified_base 198: mod_base = OTHER; note = uracil
  modified_base 200: mod_base = OTHER; note = uracil
  modified_base 202: mod_base = OTHER; note = uracil
  modified_base 212: mod_base = OTHER; note = uracil
  modified_base 216: mod_base = OTHER; note = uracil
  modified_base 220: mod_base = OTHER; note = uracil
  modified_base 222: mod_base = OTHER; note = uracil
  modified_base 230: mod_base = OTHER; note = uracil
  modified_base 249: mod_base = OTHER; note = uracil
  modified_base 263: mod_base = OTHER; note = uracil
  modified_base 273: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 295: mod_base = OTHER; note = uracil
  modified_base 297: mod_base = OTHER; note = uracil
ygggtatttaggtttygttygtttgtagtygtttggggaygygggtttyggayggttggygyggggyggggyggggattatygagtaggaagttttygyggaagygtygtygggtatagygtgggtgttgtygaggagtggygttygggyggggygggaggttataaatagyggtygttattttgtttttttttagatatatttaatttagtyggtaggtatayggatgtttatttttaaaaaaagaatttgttttattgygttygaggtgatygggaaggtgttttygygggttattyg

SEQ ID NO: 148 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 9: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 25: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 41: mod_base = OTHER; note = uracil
  modified_base 49: mod_base = OTHER; note = uracil
  modified_base 55: mod_base = OTHER; note = uracil
  modified_base 72: mod_base = OTHER; note = uracil
  modified_base 75: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 90: mod_base = OTHER; note = uracil
  modified_base 105: mod_base = OTHER; note = uracil
  modified_base 116: mod_base = OTHER; note = uracil
  modified_base 127: mod_base = OTHER; note = uracil
  modified_base 130: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 171: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 187: mod_base = OTHER; note = uracil
  modified_base 188: mod_base = OTHER; note = uracil
  modified_base 197: mod_base = OTHER; note = uracil
  modified_base 200: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 242: mod_base = OTHER; note = uracil
  modified_base 243: mod_base = OTHER; note = uracil
  modified_base 246: mod_base = OTHER; note = uracil
  modified_base 250: mod_base = OTHER; note = uracil
  modified_base 256: mod_base = OTHER; note = uracil
  modified_base 257: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 273: mod_base = OTHER; note = uracil
  modified_base 276: mod_base = OTHER; note = uracil
  modified_base 289: mod_base = OTHER; note = uracil
  modified_base 290: mod_base = OTHER; note = uracil
  modified_base 297: mod_base = OTHER; note = uracil
  modified_base 298: mod_base = OTHER; note = uracil
ygagtgattygyggggatattttttyggttatttygagygtaataaaataagttttttttttaaaaataagtattygtgtgtttgtyggttaaattaagtgtgtttgaagagaagtaggatggyggtygttatttataatttttygtttygttygggygttatttttygatagtatttaygttgtgttyggyggygttttygyggggattttttgttyggtggttttygtttygtttygygttagtygttyggaattygygtttttaggyggttgtaggygggygagatttaggtgttyg

SEQ ID NO: 149 - DNA, 300 bp, synthetic construct
  misc_feature 1..300: note = Synthetic polynucleotide
  source 1..300: mol_type = other DNA
  modified_base 33: mod_base = OTHER; note = uracil
  modified_base 38: mod_base = OTHER; note = uracil
  modified_base 43: mod_base = OTHER; note = uracil
  modified_base 44: mod_base = OTHER; note = uracil
  modified_base 54: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 89: mod_base = OTHER; note = uracil
  modified_base 90: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 118: mod_base = OTHER; note = uracil
  modified_base 123: mod_base = OTHER; note = uracil
  modified_base 130: mod_base = OTHER; note = uracil
  modified_base 131: mod_base = OTHER; note = uracil
  modified_base 138: mod_base = OTHER; note = uracil
  modified_base 160: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 197: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 256: mod_base = OTHER; note = uracil
gaaggtgyggtgyggtgaggtgagaagagagatygygttagattaggygatgttttagggaygggagaggggtgaggtttayggyggttttggggagyggtttaygatyggtttaygtagagtttgtagttagtgaataggaagtattggygagagggattgagaaatttaagagagtgtggggtgaggaaaaggttaaggaaggtttaggtttttaggaagggtttgggtyggggyggggygggtggtgggaggtagtggttaggaygggygggggtgggggtgggggtgggggtaggg

SEQ ID NO: 150 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 90: mod_base = OTHER; note = uracil
  modified_base 91: mod_base = OTHER; note = uracil
  modified_base 96: mod_base = OTHER; note = uracil
  modified_base 97: mod_base = OTHER; note = uracil
  modified_base 100: mod_base = OTHER; note = uracil
  modified_base 101: mod_base = OTHER; note = uracil
  modified_base 106: mod_base = OTHER; note = uracil
  modified_base 107: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 124: mod_base = OTHER; note = uracil
  modified_base 126: mod_base = OTHER; note = uracil
  modified_base 128: mod_base = OTHER; note = uracil
  modified_base 137: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 157: mod_base = OTHER; note = uracil
  modified_base 160: mod_base = OTHER; note = uracil
  modified_base 161: mod_base = OTHER; note = uracil
  modified_base 166: mod_base = OTHER; note = uracil
  modified_base 168: mod_base = OTHER; note = uracil
  modified_base 172: mod_base = OTHER; note = uracil
  modified_base 175: mod_base = OTHER; note = uracil
  modified_base 179: mod_base = OTHER; note = uracil
  modified_base 181: mod_base = OTHER; note = uracil
  modified_base 190: mod_base = OTHER; note = uracil
  modified_base 201: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 214: mod_base = OTHER; note = uracil
  modified_base 217: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 249: mod_base = OTHER; note = uracil
  modified_base 254: mod_base = OTHER; note = uracil
  modified_base 255: mod_base = OTHER; note = uracil
  modified_base 260: mod_base = OTHER; note = uracil
  modified_base 270: mod_base = OTHER; note = uracil
  modified_base 272: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 286: mod_base = OTHER; note = uracil
  modified_base 289: mod_base = OTHER; note = uracil
  modified_base 291: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 300: mod_base = OTHER; note = uracil
ttttatttttatttttatttttattttygttygttttaattattgttttttattattygtttygtttyggtttaggttttttttggaagtttgggttttttttgattttttttttattttatatttttttgggttttttagtttttttygttaatattttttgtttattggttataagttttgygtgggtyggtygtgggtygttttttaggatygtygtgggttttatttttttttygtttttaagatatygtttggtttagygyggtttttttttttattttatygtatygtattttt

SEQ ID NO: 151 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 14: mod_base = OTHER; note = uracil
  modified_base 38: mod_base = OTHER; note = uracil
  modified_base 39: mod_base = OTHER; note = uracil
  modified_base 53: mod_base = OTHER; note = uracil
  modified_base 59: mod_base = OTHER; note = uracil
  modified_base 63: mod_base = OTHER; note = uracil
  modified_base 64: mod_base = OTHER; note = uracil
  modified_base 69: mod_base = OTHER; note = uracil
  modified_base 72: mod_base = OTHER; note = uracil
  modified_base 88: mod_base = OTHER; note = uracil
  modified_base 92: mod_base = OTHER; note = uracil
  modified_base 93: mod_base = OTHER; note = uracil
  modified_base 96: mod_base = OTHER; note = uracil
  modified_base 101: mod_base = OTHER; note = uracil
  modified_base 109: mod_base = OTHER; note = uracil
  modified_base 113: mod_base = OTHER; note = uracil
  modified_base 127: mod_base = OTHER; note = uracil
  modified_base 141: mod_base = OTHER; note = uracil
  modified_base 146: mod_base = OTHER; note = uracil
  modified_base 149: mod_base = OTHER; note = uracil
  modified_base 165: mod_base = OTHER; note = uracil
  modified_base 167: mod_base = OTHER; note = uracil
  modified_base 170: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 186: mod_base = OTHER; note = uracil
  modified_base 187: mod_base = OTHER; note = uracil
  modified_base 197: mod_base = OTHER; note = uracil
  modified_base 199: mod_base = OTHER; note = uracil
  modified_base 201: mod_base = OTHER; note = uracil
  modified_base 209: mod_base = OTHER; note = uracil
  modified_base 216: mod_base = OTHER; note = uracil
  modified_base 218: mod_base = OTHER; note = uracil
  modified_base 224: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 235: mod_base = OTHER; note = uracil
  modified_base 248: mod_base = OTHER; note = uracil
  modified_base 254: mod_base = OTHER; note = uracil
  modified_base 261: mod_base = OTHER; note = uracil
  modified_base 264: mod_base = OTHER; note = uracil
  modified_base 271: mod_base = OTHER; note = uracil
  modified_base 275: mod_base = OTHER; note = uracil
  modified_base 282: mod_base = OTHER; note = uracil
  modified_base 284: mod_base = OTHER; note = uracil
  modified_base 297: mod_base = OTHER; note = uracil
gagaaataaaatatattttttaatttaaaaaaaagtattagaatgaataaaataggggttttttaaaattgtttttggtagatttagtaaatttattgaatttagaaatttttattttataattgttyggagatagaaagtagtgttttygaataagtggataattttgtyggttttagtaggtgttattggtgagtatatagggttgtttaagtttttaagttatttttttgattgtggtttgaattaatgttaaatatttataggggttaggtaggtaatttaatgaagtgaaatagg

SEQ ID NO: 152 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 27: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 48: mod_base = OTHER; note = uracil
  modified_base 56: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 67: mod_base = OTHER; note = uracil
  modified_base 78: mod_base = OTHER; note = uracil
  modified_base 86: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 104: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 121: mod_base = OTHER; note = uracil
  modified_base 127: mod_base = OTHER; note = uracil
  modified_base 131: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 155: mod_base = OTHER; note = uracil
  modified_base 157: mod_base = OTHER; note = uracil
  modified_base 160: mod_base = OTHER; note = uracil
  modified_base 164: mod_base = OTHER; note = uracil
  modified_base 168: mod_base = OTHER; note = uracil
  modified_base 170: mod_base = OTHER; note = uracil
  modified_base 175: mod_base = OTHER; note = uracil
  modified_base 195: mod_base = OTHER; note = uracil
  modified_base 202: mod_base = OTHER; note = uracil
  modified_base 213: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 229: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 255: mod_base = OTHER; note = uracil
  modified_base 259: mod_base = OTHER; note = uracil
  modified_base 265: mod_base = OTHER; note = uracil
  modified_base 297: mod_base = OTHER; note = uracil
  modified_base 299: mod_base = OTHER; note = uracil
ttgttttattttattgagttatttgtttgatttttgtagatatttgatattgatttaaattatagttagggaaatgatttagagatttaagtaattttgtgtgtttattaatggtatttattgggatyggtagagttatttatttattyggaagtattgttttttattttyggataattataaaatgaaagtttttaagtttagtaggtttgttaaatttattaaaagtagttttggaaagtttttgttttatttattttggtatttttttttaaattaaaaaatgtattttgttttttt

SEQ ID NO: 153 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 10: mod_base = OTHER; note = uracil
  modified_base 12: mod_base = OTHER; note = uracil
  modified_base 16: mod_base = OTHER; note = uracil
  modified_base 30: mod_base = OTHER; note = uracil
  modified_base 31: mod_base = OTHER; note = uracil
  modified_base 38: mod_base = OTHER; note = uracil
  modified_base 55: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 145: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 179: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 199: mod_base = OTHER; note = uracil
  modified_base 200: mod_base = OTHER; note = uracil
  modified_base 205: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 242: mod_base = OTHER; note = uracil
  modified_base 244: mod_base = OTHER; note = uracil
  modified_base 249: mod_base = OTHER; note = uracil
  modified_base 250: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 263: mod_base = OTHER; note = uracil
  modified_base 264: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 276: mod_base = OTHER; note = uracil
  modified_base 280: mod_base = OTHER; note = uracil
  modified_base 281: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 298: mod_base = OTHER; note = uracil
  modified_base 300: mod_base = OTHER; note = uracil
ggagggttttatygttagygtagygtaygtttgygggtyggggygggagagggatygtygygtttgtgtygttagtatttgyggtttttagygtattygggttttaygyggtagtttttagggagtggggagtygggygggaaatagttygttygggtttttaygggtgtttttttygtygygttttttttygagggttttttgtagtygggygtggaagtgggatgagtaaatttygtagtatagggttttygttttaggatttgtattttttatyggttaygggaygttttttygtat

SEQ ID NO: 154 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 16: mod_base = OTHER; note = uracil
  modified_base 22: mod_base = OTHER; note = uracil
  modified_base 35: mod_base = OTHER; note = uracil
  modified_base 40: mod_base = OTHER; note = uracil
  modified_base 41: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 60: mod_base = OTHER; note = uracil
  modified_base 72: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 97: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 144: mod_base = OTHER; note = uracil
  modified_base 145: mod_base = OTHER; note = uracil
  modified_base 154: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 187: mod_base = OTHER; note = uracil
  modified_base 190: mod_base = OTHER; note = uracil
  modified_base 200: mod_base = OTHER; note = uracil
  modified_base 201: mod_base = OTHER; note = uracil
  modified_base 210: mod_base = OTHER; note = uracil
  modified_base 217: mod_base = OTHER; note = uracil
  modified_base 220: mod_base = OTHER; note = uracil
  modified_base 226: mod_base = OTHER; note = uracil
  modified_base 233: mod_base = OTHER; note = uracil
  modified_base 235: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 278: mod_base = OTHER; note = uracil
  modified_base 283: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
gtgyggagggaygtttygtggtyggtagagggtgtaggttttggggygaaggttttgtgttgyggggtttgtttattttatttttaygttygattgtaaaggattttygggagggagygyggygaaaggggtattygtaggagttygggygagttgtttttygttygattttttattttttgggggttatygygtggggttygggtgygttgggggtygtaggtgttggyggtataaaygygayggtttttttttygtttyggttygtaggygtaygttaygttgayggtgaagtttttt

SEQ ID NO: 155 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 23: mod_base = OTHER; note = uracil
  modified_base 27: mod_base = OTHER; note = uracil
  modified_base 29: mod_base = OTHER; note = uracil
  modified_base 43: mod_base = OTHER; note = uracil
  modified_base 51: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 94: mod_base = OTHER; note = uracil
  modified_base 97: mod_base = OTHER; note = uracil
  modified_base 101: mod_base = OTHER; note = uracil
  modified_base 108: mod_base = OTHER; note = uracil
  modified_base 114: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 130: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 148: mod_base = OTHER; note = uracil
  modified_base 156: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 199: mod_base = OTHER; note = uracil
  modified_base 210: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 224: mod_base = OTHER; note = uracil
  modified_base 229: mod_base = OTHER; note = uracil
  modified_base 240: mod_base = OTHER; note = uracil
  modified_base 241: mod_base = OTHER; note = uracil
  modified_base 249: mod_base = OTHER; note = uracil
  modified_base 250: mod_base = OTHER; note = uracil
  modified_base 272: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 300: mod_base = OTHER; note = uracil
agatataaagagggyggagagatagatatagaaagagggagatagyggggttggatggaygtgtggtygggttagtggggaggagagaygagttygtagatagygtttagaggtygygttgtttgggtgttgagtygtttyggggtttayggtygtagtttgtttttataaaaygtttagtygtttygatttgtggtgtttagggaggatttatttggttgtgtyggtttgagaaggggttagtgaggttyggtgygggtaygggygggtgtagatgtagttaggaggaygggygggagt

SEQ ID NO: 156 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 5: mod_base = OTHER; note = uracil
  modified_base 8: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 21: mod_base = OTHER; note = uracil
  modified_base 24: mod_base = OTHER; note = uracil
  modified_base 27: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 37: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 48: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 58: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 78: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 121: mod_base = OTHER; note = uracil
  modified_base 139: mod_base = OTHER; note = uracil
  modified_base 143: mod_base = OTHER; note = uracil
  modified_base 149: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 180: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 198: mod_base = OTHER; note = uracil
  modified_base 202: mod_base = OTHER; note = uracil
  modified_base 209: mod_base = OTHER; note = uracil
  modified_base 214: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 243: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 256: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 266: mod_base = OTHER; note = uracil
  modified_base 270: mod_base = OTHER; note = uracil
  modified_base 276: mod_base = OTHER; note = uracil
  modified_base 280: mod_base = OTHER; note = uracil
  modified_base 282: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 291: mod_base = OTHER; note = uracil
  modified_base 299: mod_base = OTHER; note = uracil
gttttygttygtttttttggttgtatttgtattygttygtattygtatygggttttattggtttttttttagatyggtatagttaggtaggttttttttaagtattataggtyggggyggttgggygttttgtaaggataaattgygatygtgaatttygggayggtttagtatttaggtagygyggtttttgaaygttgtttgyggattygttttttttttttattggttyggttataygtttatttagtttygttgtttttttttttttgtgtttgttttttygttttttttgtgttt

SEQ ID NO: 157 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 8: mod_base = OTHER; note = uracil
  modified_base 10: mod_base = OTHER; note = uracil
  modified_base 15: mod_base = OTHER; note = uracil
  modified_base 23: mod_base = OTHER; note = uracil
  modified_base 25: mod_base = OTHER; note = uracil
  modified_base 45: mod_base = OTHER; note = uracil
  modified_base 50: mod_base = OTHER; note = uracil
  modified_base 59: mod_base = OTHER; note = uracil
  modified_base 61: mod_base = OTHER; note = uracil
  modified_base 67: mod_base = OTHER; note = uracil
  modified_base 69: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 93: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 112: mod_base = OTHER; note = uracil
  modified_base 114: mod_base = OTHER; note = uracil
  modified_base 117: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 130: mod_base = OTHER; note = uracil
  modified_base 137: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 160: mod_base = OTHER; note = uracil
  modified_base 162: mod_base = OTHER; note = uracil
  modified_base 164: mod_base = OTHER; note = uracil
  modified_base 167: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 221: mod_base = OTHER; note = uracil
  modified_base 242: mod_base = OTHER; note = uracil
  modified_base 243: mod_base = OTHER; note = uracil
  modified_base 256: mod_base = OTHER; note = uracil
  modified_base 257: mod_base = OTHER; note = uracil
  modified_base 263: mod_base = OTHER; note = uracil
  modified_base 267: mod_base = OTHER; note = uracil
  modified_base 271: mod_base = OTHER; note = uracil
  modified_base 275: mod_base = OTHER; note = uracil
  modified_base 280: mod_base = OTHER; note = uracil
  modified_base 287: mod_base = OTHER; note = uracil
  modified_base 289: mod_base = OTHER; note = uracil
  modified_base 298: mod_base = OTHER; note = uracil
gttgttatattgagttgtttaatatttaagatgttggtggatggtaaagttaaaagagtattgtaatatatgatttttggggttttyggagttatgagtattttttttagatatagtygtggggttatatagaattttgtttttgttgtygttyggaagtatttatttggtttttgtatttatttatttgtatttttttttttttaygaggtgttaagagttgtgggatgagtaaaggaggtttgtgaaggattttttgttttagttttatatttaggtttgagtttttagaggaatttt

SEQ ID NO: 158 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 10: mod_base = OTHER; note = uracil
  modified_base 17: mod_base = OTHER; note = uracil
  modified_base 19: mod_base = OTHER; note = uracil
  modified_base 23: mod_base = OTHER; note = uracil
  modified_base 24: mod_base = OTHER; note = uracil
  modified_base 36: mod_base = OTHER; note = uracil
  modified_base 42: mod_base = OTHER; note = uracil
  modified_base 50: mod_base = OTHER; note = uracil
  modified_base 51: mod_base = OTHER; note = uracil
  modified_base 54: mod_base = OTHER; note = uracil
  modified_base 56: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 69: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 81: mod_base = OTHER; note = uracil
  modified_base 83: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 111: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 142: mod_base = OTHER; note = uracil
  modified_base 145: mod_base = OTHER; note = uracil
  modified_base 153: mod_base = OTHER; note = uracil
  modified_base 156: mod_base = OTHER; note = uracil
  modified_base 162: mod_base = OTHER; note = uracil
  modified_base 169: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 185: mod_base = OTHER; note = uracil
  modified_base 191: mod_base = OTHER; note = uracil
  modified_base 203: mod_base = OTHER; note = uracil
  modified_base 205: mod_base = OTHER; note = uracil
  modified_base 210: mod_base = OTHER; note = uracil
  modified_base 212: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 229: mod_base = OTHER; note = uracil
  modified_base 238: mod_base = OTHER; note = uracil
  modified_base 243: mod_base = OTHER; note = uracil
  modified_base 245: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 271: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 297: mod_base = OTHER; note = uracil
  modified_base 300: mod_base = OTHER; note = uracil
aagatttttttgagaatttagatttgaatgtaagattgaaataggaaattttttataggttttttttatttattttatagtttttaatatttygtgggagggggaggatgtaggtgagtgggtgtaggagttagatgagtgttttygggyggtagtaggagtagaattttgtgtggttttayggttgtgtttagaaggggtatttatgatttygggagttttagaggttatgtgttatagtgtttttttagttttgttatttattaatattttaagtgttaaatagtttagtgtgatagt

SEQ ID NO: 159 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 24: mod_base = OTHER; note = uracil
  modified_base 34: mod_base = OTHER; note = uracil
  modified_base 35: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 60: mod_base = OTHER; note = uracil
  modified_base 64: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 79: mod_base = OTHER; note = uracil
  modified_base 92: mod_base = OTHER; note = uracil
  modified_base 94: mod_base = OTHER; note = uracil
  modified_base 99: mod_base = OTHER; note = uracil
  modified_base 111: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 156: mod_base = OTHER; note = uracil
  modified_base 158: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 187: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 249: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 288: mod_base = OTHER; note = uracil
  modified_base 291: mod_base = OTHER; note = uracil
  modified_base 293: mod_base = OTHER; note = uracil
tagggttgggagaataggatggatagygttttgttagagttttatgggaagtttttttttaggtagttgaatttattttaggggtagggagtattgattaggggttgggatattgtttygggaggaggatgaggatgtttttaggtttyggttgatttatggtagtgagtattagttatttttttataagaattagtttatattttttagtagttttttgttttttagaggtttttgttttatgtttatttgtttgaagtttttttttyggtygtttttatttatattygtatagtttgg

SEQ ID NO: 160 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 29: mod_base = OTHER; note = uracil
  modified_base 41: mod_base = OTHER; note = uracil
  modified_base 44: mod_base = OTHER; note = uracil
  modified_base 48: mod_base = OTHER; note = uracil
  modified_base 56: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 80: mod_base = OTHER; note = uracil
  modified_base 87: mod_base = OTHER; note = uracil
  modified_base 90: mod_base = OTHER; note = uracil
  modified_base 104: mod_base = OTHER; note = uracil
  modified_base 110: mod_base = OTHER; note = uracil
  modified_base 125: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 146: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 185: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 204: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 231: mod_base = OTHER; note = uracil
  modified_base 234: mod_base = OTHER; note = uracil
  modified_base 237: mod_base = OTHER; note = uracil
  modified_base 238: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 261: mod_base = OTHER; note = uracil
  modified_base 263: mod_base = OTHER; note = uracil
  modified_base 267: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 300: mod_base = OTHER; note = uracil
taaattgtgyggatgtgggtgggggyggtygggagaggagttttaggtaggtaaatatggggtaggggtttttgggagataagaggttattagaggatgtgggttgatttttgtgagggagtgattaatatttattattatgagttagtygaggtttggaaatatttttatttttttttyggggtaatgttttaatttttgattagtgttttttatttttgaaatgggtttagttgtttgaaaggaagttttttatgaggttttggtaaaaygttgtttattttatttttttagttttgt

SEQ ID NO: 161 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 16: mod_base = OTHER; note = uracil
  modified_base 17: mod_base = OTHER; note = uracil
  modified_base 25: mod_base = OTHER; note = uracil
  modified_base 30: mod_base = OTHER; note = uracil
  modified_base 37: mod_base = OTHER; note = uracil
  modified_base 39: mod_base = OTHER; note = uracil
  modified_base 52: mod_base = OTHER; note = uracil
  modified_base 79: mod_base = OTHER; note = uracil
  modified_base 85: mod_base = OTHER; note = uracil
  modified_base 95: mod_base = OTHER; note = uracil
  modified_base 112: mod_base = OTHER; note = uracil
  modified_base 114: mod_base = OTHER; note = uracil
  modified_base 129: mod_base = OTHER; note = uracil
  modified_base 142: mod_base = OTHER; note = uracil
  modified_base 144: mod_base = OTHER; note = uracil
  modified_base 148: mod_base = OTHER; note = uracil
  modified_base 149: mod_base = OTHER; note = uracil
  modified_base 156: mod_base = OTHER; note = uracil
  modified_base 161: mod_base = OTHER; note = uracil
  modified_base 163: mod_base = OTHER; note = uracil
  modified_base 173: mod_base = OTHER; note = uracil
  modified_base 174: mod_base = OTHER; note = uracil
  modified_base 183: mod_base = OTHER; note = uracil
  modified_base 188: mod_base = OTHER; note = uracil
  modified_base 196: mod_base = OTHER; note = uracil
  modified_base 210: mod_base = OTHER; note = uracil
  modified_base 213: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 252: mod_base = OTHER; note = uracil
  modified_base 262: mod_base = OTHER; note = uracil
  modified_base 279: mod_base = OTHER; note = uracil
  modified_base 280: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 295: mod_base = OTHER; note = uracil
  modified_base 297: mod_base = OTHER; note = uracil
gaggattaaaagaagttagagatgttggttaattgatataaaaataaagagttaagggagaggttgagagagggagagtaatatttatgggtgtttggaatttttaaagggtttagaggaggagggggtygggygtggtggtttaygtttgttattygagtattttgggaggttaaggtgggtaaattaygaggttaggagtttgagagtagtttgattaatatggtgtaatttygtttttattaaaaatataaaatttagtygggtgtggttgtgtgtttgtaattttagttatttagg

SEQ ID NO: 162 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 10: mod_base = OTHER; note = uracil
  modified_base 19: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 85: mod_base = OTHER; note = uracil
  modified_base 89: mod_base = OTHER; note = uracil
  modified_base 92: mod_base = OTHER; note = uracil
  modified_base 94: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 108: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 141: mod_base = OTHER; note = uracil
  modified_base 150: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 169: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 223: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 252: mod_base = OTHER; note = uracil
  modified_base 266: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 280: mod_base = OTHER; note = uracil
  modified_base 282: mod_base = OTHER; note = uracil
  modified_base 286: mod_base = OTHER; note = uracil
  modified_base 289: mod_base = OTHER; note = uracil
  modified_base 297: mod_base = OTHER; note = uracil
  modified_base 298: mod_base = OTHER; note = uracil
  modified_base 300: mod_base = OTHER; note = uracil
tttgagtagttgggattataggtatataattatattyggttaaattttgtatttttagtagagayggggttgtattatgttggttaggttgtttttaaatttttgatttygtgatttgtttattttggttttttaaagtgttyggataataggygtgagttattaygttyggttttttttttttttgagttttttaaaaattttagatatttatagatattgtttttttttttttaattttttttttagttttttatttttgtgttaattgattagtatttttggttttttttagttttt

SEQ ID NO: 163 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 8: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 24: mod_base = OTHER; note = uracil
  modified_base 29: mod_base = OTHER; note = uracil
  modified_base 31: mod_base = OTHER; note = uracil
  modified_base 38: mod_base = OTHER; note = uracil
  modified_base 45: mod_base = OTHER; note = uracil
  modified_base 48: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 66: mod_base = OTHER; note = uracil
  modified_base 75: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 119: mod_base = OTHER; note = uracil
  modified_base 122: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 157: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 201: mod_base = OTHER; note = uracil
  modified_base 211: mod_base = OTHER; note = uracil
  modified_base 212: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 233: mod_base = OTHER; note = uracil
  modified_base 238: mod_base = OTHER; note = uracil
  modified_base 249: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 273: mod_base = OTHER; note = uracil
  modified_base 277: mod_base = OTHER; note = uracil
  modified_base 278: mod_base = OTHER; note = uracil
  modified_base 287: mod_base = OTHER; note = uracil
  modified_base 289: mod_base = OTHER; note = uracil
  modified_base 292: mod_base = OTHER; note = uracil
ttaggagttygtttgggagygygtagygttttaggagtygagagtygttgtttggttttygttggtygggtaaatygaggggaagtttttggtttttttttttttaagttttttattgtttttgtggggaaggtttttttaggtagaggygaaggatyggggagataattttttttatgggttatattygttgttatggtttgtgtygtgttagaaggtattttttagtttttagtgtygtgaaaaatttgatatttaagaaggtygattgataygtttaaygtygtatagtaatttagt

SEQ ID NO: 164 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 10: mod_base = OTHER; note = uracil
  modified_base 30: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 50: mod_base = OTHER; note = uracil
  modified_base 59: mod_base = OTHER; note = uracil
  modified_base 64: mod_base = OTHER; note = uracil
  modified_base 66: mod_base = OTHER; note = uracil
  modified_base 73: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 91: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 108: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 168: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 183: mod_base = OTHER; note = uracil
  modified_base 193: mod_base = OTHER; note = uracil
  modified_base 209: mod_base = OTHER; note = uracil
  modified_base 210: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 231: mod_base = OTHER; note = uracil
  modified_base 232: mod_base = OTHER; note = uracil
  modified_base 236: mod_base = OTHER; note = uracil
  modified_base 237: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 257: mod_base = OTHER; note = uracil
  modified_base 259: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 275: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 294: mod_base = OTHER; note = uracil
  modified_base 296: mod_base = OTHER; note = uracil
  modified_base 297: mod_base = OTHER; note = uracil
attaaattgttgtgygaygttaggygtgttaatygatttttttgagtgttagattttttayggtattgagggttgagaggtattttttggtaygatatagattatggtagyggatgtggtttatgggagaggttattttttyggtttttygtttttatttaggagggttttttttatagaagtaataaggggtttaagggaaaggaggttaggagttttttttyggtttattyggttagygagggttaagtagyggttttyggtttttagagygttgygygtttttaggygggtttttgg

SEQ ID NO: 165 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 12: mod_base = OTHER; note = uracil
  modified_base 15: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 29: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 49: mod_base = OTHER; note = uracil
  modified_base 57: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 71: mod_base = OTHER; note = uracil
  modified_base 76: mod_base = OTHER; note = uracil
  modified_base 81: mod_base = OTHER; note = uracil
  modified_base 88: mod_base = OTHER; note = uracil
  modified_base 92: mod_base = OTHER; note = uracil
  modified_base 93: mod_base = OTHER; note = uracil
  modified_base 97: mod_base = OTHER; note = uracil
  modified_base 118: mod_base = OTHER; note = uracil
  modified_base 120: mod_base = OTHER; note = uracil
  modified_base 122: mod_base = OTHER; note = uracil
  modified_base 127: mod_base = OTHER; note = uracil
  modified_base 129: mod_base = OTHER; note = uracil
  modified_base 153: mod_base = OTHER; note = uracil
  modified_base 157: mod_base = OTHER; note = uracil
  modified_base 159: mod_base = OTHER; note = uracil
  modified_base 164: mod_base = OTHER; note = uracil
  modified_base 170: mod_base = OTHER; note = uracil
  modified_base 172: mod_base = OTHER; note = uracil
  modified_base 178: mod_base = OTHER; note = uracil
  modified_base 181: mod_base = OTHER; note = uracil
  modified_base 191: mod_base = OTHER; note = uracil
  modified_base 198: mod_base = OTHER; note = uracil
  modified_base 204: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 218: mod_base = OTHER; note = uracil
  modified_base 239: mod_base = OTHER; note = uracil
  modified_base 243: mod_base = OTHER; note = uracil
  modified_base 261: mod_base = OTHER; note = uracil
  modified_base 268: mod_base = OTHER; note = uracil
  modified_base 272: mod_base = OTHER; note = uracil
  modified_base 278: mod_base = OTHER; note = uracil
  modified_base 282: mod_base = OTHER; note = uracil
  modified_base 285: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 298: mod_base = OTHER; note = uracil
gaggtaygaagttgtyggagttatttagttttatttttaggaaagatatagygaattatygttaataaaataaagtaaaataaaaagttygttatgttgaayggaatgggaaaattgtttttttgttattaattttgattgaattgagtyggtaatttttgaatyggtttattgatataataataggaaatatttaattgttttttgtatttttaaatataaatagtaggtttttaagtagttagtaggygatgtgtgattaaggtttagatagaygtagataattgattatttatttag

SEQ ID NO: 166 - DNA, 299 bp, synthetic construct
  misc_feature 1..299: note = Synthetic polynucleotide
  source 1..299: mol_type = other DNA
  modified_base 1: mod_base = OTHER; note = uracil
  modified_base 14: mod_base = OTHER; note = uracil
  modified_base 21: mod_base = OTHER; note = uracil
  modified_base 27: mod_base = OTHER; note = uracil
  modified_base 31: mod_base = OTHER; note = uracil
  modified_base 36: mod_base = OTHER; note = uracil
  modified_base 37: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 52: mod_base = OTHER; note = uracil
  modified_base 53: mod_base = OTHER; note = uracil
  modified_base 56: mod_base = OTHER; note = uracil
  modified_base 60: mod_base = OTHER; note = uracil
  modified_base 63: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 94: mod_base = OTHER; note = uracil
  modified_base 101: mod_base = OTHER; note = uracil
  modified_base 114: mod_base = OTHER; note = uracil
  modified_base 115: mod_base = OTHER; note = uracil
  modified_base 127: mod_base = OTHER; note = uracil
  modified_base 134: mod_base = OTHER; note = uracil
  modified_base 140: mod_base = OTHER; note = uracil
  modified_base 149: mod_base = OTHER; note = uracil
  modified_base 153: mod_base = OTHER; note = uracil
  modified_base 155: mod_base = OTHER; note = uracil
  modified_base 160: mod_base = OTHER; note = uracil
  modified_base 164: mod_base = OTHER; note = uracil
  modified_base 176: mod_base = OTHER; note = uracil
  modified_base 184: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 202: mod_base = OTHER; note = uracil
  modified_base 205: mod_base = OTHER; note = uracil
  modified_base 214: mod_base = OTHER; note = uracil
  modified_base 226: mod_base = OTHER; note = uracil
  modified_base 250: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 273: mod_base = OTHER; note = uracil
  modified_base 281: mod_base = OTHER; note = uracil
  modified_base 283: mod_base = OTHER; note = uracil
  modified_base 287: mod_base = OTHER; note = uracil
  modified_base 290: mod_base = OTHER; note = uracil
  modified_base 297: mod_base = OTHER; note = uracil
  modified_base 298: mod_base = OTHER; note = uracil
ttgagtgggtgattagttgtttgygtttgtttgaattttgattatatatygtttattgattgtttaaaaatttattatttatgtttaaaggtgtaagaaatagttaaatgttttttattgttgtattagtgaatyggtttagagattgtygatttaatttaattaaaattagtgataagagagtaatttttttatttygtttagtatggygagttttttgttttgttttgttttattggyggtgattygttgtattttttttagaggtaaagttgagtagtttyggtagtttygtgttt

SEQ ID NO: 167 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 9: mod_base = OTHER; note = uracil
  modified_base 11: mod_base = OTHER; note = uracil
  modified_base 19: mod_base = OTHER; note = uracil
  modified_base 21: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 48: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 80: mod_base = OTHER; note = uracil
  modified_base 83: mod_base = OTHER; note = uracil
  modified_base 85: mod_base = OTHER; note = uracil
  modified_base 95: mod_base = OTHER; note = uracil
  modified_base 99: mod_base = OTHER; note = uracil
  modified_base 100: mod_base = OTHER; note = uracil
  modified_base 102: mod_base = OTHER; note = uracil
  modified_base 112: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 133: mod_base = OTHER; note = uracil
  modified_base 142: mod_base = OTHER; note = uracil
  modified_base 146: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 198: mod_base = OTHER; note = uracil
  modified_base 199: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 220: mod_base = OTHER; note = uracil
  modified_base 221: mod_base = OTHER; note = uracil
  modified_base 234: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 259: mod_base = OTHER; note = uracil
  modified_base 262: mod_base = OTHER; note = uracil
  modified_base 266: mod_base = OTHER; note = uracil
  modified_base 267: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 289: mod_base = OTHER; note = uracil
  modified_base 290: mod_base = OTHER; note = uracil
  modified_base 300: mod_base = OTHER; note = uracil
gattttagtttygggtgatatyggtgggygtygggtgtggttttagatagtttttttttttttyggttggttgttaggttaatatygggtgggattagtttttggtgtyggtagtagttttatgttttyggtttttgggtttttgtatgygtygtttttattatttggttgttttttttattttygtttttatttgtttygggttatttgttttttaagttagaaattaaggatagtatttttttttagatygtttggttgtagtttygggatgggygtttttagtygtttagatygggt

SEQ ID NO: 168 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 8: mod_base = OTHER; note = uracil
  modified_base 16: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 52: mod_base = OTHER; note = uracil
  modified_base 65: mod_base = OTHER; note = uracil
  modified_base 69: mod_base = OTHER; note = uracil
  modified_base 70: mod_base = OTHER; note = uracil
  modified_base 78: mod_base = OTHER; note = uracil
  modified_base 82: mod_base = OTHER; note = uracil
  modified_base 91: mod_base = OTHER; note = uracil
  modified_base 98: mod_base = OTHER; note = uracil
  modified_base 99: mod_base = OTHER; note = uracil
  modified_base 105: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 152: mod_base = OTHER; note = uracil
  modified_base 156: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 170: mod_base = OTHER; note = uracil
  modified_base 177: mod_base = OTHER; note = uracil
  modified_base 184: mod_base = OTHER; note = uracil
  modified_base 187: mod_base = OTHER; note = uracil
  modified_base 190: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 223: mod_base = OTHER; note = uracil
  modified_base 224: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 251: mod_base = OTHER; note = uracil
  modified_base 255: mod_base = OTHER; note = uracil
  modified_base 261: mod_base = OTHER; note = uracil
  modified_base 262: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 293: mod_base = OTHER; note = uracil
  modified_base 300: mod_base = OTHER; note = uracil
gttygatttaggygattaggagygtttatttygggattgtagttaggyggtttgggagggggtgttgtttttaatttttggtttgaaggataggtgattygggataggtggagayggaagtgagaggggtagttaggtgatggggayggygtatgtaagaatttaaaggtygggagtatggggttattgtygatattagaggttagttttattyggtgttgatttggtaattagtyggggaggaagggagttgtttgaggttatattygaygtttatyggtgttattyggagttgaggtt

SEQ ID NO: 169 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 23: mod_base = OTHER; note = uracil
  modified_base 25: mod_base = OTHER; note = uracil
  modified_base 28: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 46: mod_base = OTHER; note = uracil
  modified_base 52: mod_base = OTHER; note = uracil
  modified_base 53: mod_base = OTHER; note = uracil
  modified_base 56: mod_base = OTHER; note = uracil
  modified_base 59: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 97: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 107: mod_base = OTHER; note = uracil
  modified_base 109: mod_base = OTHER; note = uracil
  modified_base 112: mod_base = OTHER; note = uracil
  modified_base 119: mod_base = OTHER; note = uracil
  modified_base 121: mod_base = OTHER; note = uracil
  modified_base 139: mod_base = OTHER; note = uracil
  modified_base 146: mod_base = OTHER; note = uracil
  modified_base 153: mod_base = OTHER; note = uracil
  modified_base 164: mod_base = OTHER; note = uracil
  modified_base 168: mod_base = OTHER; note = uracil
  modified_base 178: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 201: mod_base = OTHER; note = uracil
  modified_base 206: mod_base = OTHER; note = uracil
  modified_base 220: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 238: mod_base = OTHER; note = uracil
  modified_base 240: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 267: mod_base = OTHER; note = uracil
  modified_base 268: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 297: mod_base = OTHER; note = uracil
gtatttgtgttaattagyggtttttagtttggttttatttagggtttgaagtttattatagaatttttagtagtaygtggggtgtatagtaaagattagttttggatatagtygggtgtttagggyggggtgagggggtaggaggtaggaygtaggaggtgagttgttygggyggggtaggatgagggagttttgtattgtagagttaagggggagaattattagtattttaattagtttttgatggtttttaaagttttttaagttttttttttttttttttttttttatttttataag

SEQ ID NO: 170 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 36: mod_base = OTHER; note = uracil
  modified_base 45: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 64: mod_base = OTHER; note = uracil
  modified_base 76: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 96: mod_base = OTHER; note = uracil
  modified_base 98: mod_base = OTHER; note = uracil
  modified_base 101: mod_base = OTHER; note = uracil
  modified_base 106: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 135: mod_base = OTHER; note = uracil
  modified_base 138: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 196: mod_base = OTHER; note = uracil
  modified_base 197: mod_base = OTHER; note = uracil
  modified_base 202: mod_base = OTHER; note = uracil
  modified_base 207: mod_base = OTHER; note = uracil
  modified_base 212: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 228: mod_base = OTHER; note = uracil
  modified_base 231: mod_base = OTHER; note = uracil
  modified_base 240: mod_base = OTHER; note = uracil
  modified_base 250: mod_base = OTHER; note = uracil
  modified_base 253: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 269: mod_base = OTHER; note = uracil
  modified_base 270: mod_base = OTHER; note = uracil
  modified_base 274: mod_base = OTHER; note = uracil
  modified_base 281: mod_base = OTHER; note = uracil
  modified_base 284: mod_base = OTHER; note = uracil
  modified_base 292: mod_base = OTHER; note = uracil
  modified_base 294: mod_base = OTHER; note = uracil
  modified_base 300: mod_base = OTHER; note = uracil
tttgtagggataaaaaaaaaaaaaaaaaaaaaggatttaaaaggttttggaagttattaagagttaattagggtgttgatgatttttttttttagttttgtaatgtaggatttttttattttgtttygttyggatagtttattttttgygttttgttttttgtttttttatttygttttgagtattyggttgtgtttagggttgatttttgttgtgtattttaygtgttgttgggggttttgtagtaggttttaggttttggatgaggttaggttgagaatygttggttgatatagatat

SEQ ID NO: 171 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 19: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 36: mod_base = OTHER; note = uracil
  modified_base 43: mod_base = OTHER; note = uracil
  modified_base 49: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 84: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 110: mod_base = OTHER; note = uracil
  modified_base 113: mod_base = OTHER; note = uracil
  modified_base 115: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 130: mod_base = OTHER; note = uracil
  modified_base 140: mod_base = OTHER; note = uracil
  modified_base 142: mod_base = OTHER; note = uracil
  modified_base 146: mod_base = OTHER; note = uracil
  modified_base 150: mod_base = OTHER; note = uracil
  modified_base 157: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 172: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 205: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 218: mod_base = OTHER; note = uracil
  modified_base 220: mod_base = OTHER; note = uracil
  modified_base 227: mod_base = OTHER; note = uracil
  modified_base 237: mod_base = OTHER; note = uracil
  modified_base 245: mod_base = OTHER; note = uracil
  modified_base 260: mod_base = OTHER; note = uracil
  modified_base 261: mod_base = OTHER; note = uracil
  modified_base 267: mod_base = OTHER; note = uracil
  modified_base 268: mod_base = OTHER; note = uracil
  modified_base 271: mod_base = OTHER; note = uracil
  modified_base 277: mod_base = OTHER; note = uracil
  modified_base 288: mod_base = OTHER; note = uracil
  modified_base 290: mod_base = OTHER; note = uracil
  modified_base 295: mod_base = OTHER; note = uracil
gattaatttgttttttgataagttatattttttagtttagtattaaggtagaagagagttttgttgaagagttygtttgtgttttgtggtaaagatataggtttatyggttttttygtgggttttagtgttgagaagggtataggttggttggagatagtgttttgtttgatagatttttttaygttyggatttttttagtttgtatyggttatttgtattggttttayggaagagttagaattttgttttaatgttggttagtttttattattagtttgaaaagaatatagaatttayg

SEQ ID NO: 172 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 16: mod_base = OTHER; note = uracil
  modified_base 21: mod_base = OTHER; note = uracil
  modified_base 25: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 54: mod_base = OTHER; note = uracil
  modified_base 61: mod_base = OTHER; note = uracil
  modified_base 65: mod_base = OTHER; note = uracil
  modified_base 67: mod_base = OTHER; note = uracil
  modified_base 70: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 91: mod_base = OTHER; note = uracil
  modified_base 97: mod_base = OTHER; note = uracil
  modified_base 101: mod_base = OTHER; note = uracil
  modified_base 111: mod_base = OTHER; note = uracil
  modified_base 127: mod_base = OTHER; note = uracil
  modified_base 131: mod_base = OTHER; note = uracil
  modified_base 135: mod_base = OTHER; note = uracil
  modified_base 140: mod_base = OTHER; note = uracil
  modified_base 142: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 174: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 192: mod_base = OTHER; note = uracil
  modified_base 200: mod_base = OTHER; note = uracil
  modified_base 201: mod_base = OTHER; note = uracil
  modified_base 207: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 220: mod_base = OTHER; note = uracil
  modified_base 222: mod_base = OTHER; note = uracil
  modified_base 230: mod_base = OTHER; note = uracil
  modified_base 232: mod_base = OTHER; note = uracil
  modified_base 235: mod_base = OTHER; note = uracil
  modified_base 238: mod_base = OTHER; note = uracil
  modified_base 243: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 261: mod_base = OTHER; note = uracil
  modified_base 266: mod_base = OTHER; note = uracil
  modified_base 279: mod_base = OTHER; note = uracil
  modified_base 284: mod_base = OTHER; note = uracil
  modified_base 291: mod_base = OTHER; note = uracil
  modified_base 300: mod_base = OTHER; note = uracil
ygtaagttttgtgttttttttaagttaatgatggaaattggttaatattaaaatagaattttagttttttygtgaaattagtgtaggtggtyggtgtagattggaaggattygagygtggaggggtttgttaagtagggtattgtttttagttagtttgtgttttttttagtattgggatttayggagaagtyggtaggtttgtgtttttattatagaatataagygggttttttaatagggtttttttttgttttagtattaagttaaagggtatgatttgttaggaggtaagttaatt

SEQ ID NO: 173 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 16: mod_base = OTHER; note = uracil
  modified_base 20: mod_base = OTHER; note = uracil
  modified_base 24: mod_base = OTHER; note = uracil
  modified_base 25: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 68: mod_base = OTHER; note = uracil
  modified_base 73: mod_base = OTHER; note = uracil
  modified_base 75: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 87: mod_base = OTHER; note = uracil
  modified_base 89: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 134: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 187: mod_base = OTHER; note = uracil
  modified_base 190: mod_base = OTHER; note = uracil
  modified_base 193: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 214: mod_base = OTHER; note = uracil
  modified_base 226: mod_base = OTHER; note = uracil
  modified_base 230: mod_base = OTHER; note = uracil
  modified_base 241: mod_base = OTHER; note = uracil
  modified_base 242: mod_base = OTHER; note = uracil
  modified_base 250: mod_base = OTHER; note = uracil
  modified_base 262: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 284: mod_base = OTHER; note = uracil
  modified_base 290: mod_base = OTHER; note = uracil
  modified_base 295: mod_base = OTHER; note = uracil
  modified_base 296: mod_base = OTHER; note = uracil
gattataggtgtgtgttattatgttygggtaatttttatattttttggttttattatgttgtttaggttggttttaaatttttgggtttaagtgatttttttgttttagttttttaaagtgttggattagaggtatgagttattttgtaygtttgttttttgattttaggtttttayggagttggttattttttgggtttygtttagtyggtgttgaaggtgagttatgttygatgatgatttgaggagtagaagaaggtgtaggtgagttatttgaggggaattgggttatgattagag

SEQ ID NO: 174 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 32: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 49: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 62: mod_base = OTHER; note = uracil
  modified_base 65: mod_base = OTHER; note = uracil
  modified_base 72: mod_base = OTHER; note = uracil
  modified_base 77: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 88: mod_base = OTHER; note = uracil
  modified_base 90: mod_base = OTHER; note = uracil
  modified_base 94: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 116: mod_base = OTHER; note = uracil
  modified_base 117: mod_base = OTHER; note = uracil
  modified_base 120: mod_base = OTHER; note = uracil
  modified_base 122: mod_base = OTHER; note = uracil
  modified_base 131: mod_base = OTHER; note = uracil
  modified_base 132: mod_base = OTHER; note = uracil
  modified_base 139: mod_base = OTHER; note = uracil
  modified_base 146: mod_base = OTHER; note = uracil
  modified_base 154: mod_base = OTHER; note = uracil
  modified_base 162: mod_base = OTHER; note = uracil
  modified_base 164: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 182: mod_base = OTHER; note = uracil
  modified_base 192: mod_base = OTHER; note = uracil
  modified_base 198: mod_base = OTHER; note = uracil
  modified_base 207: mod_base = OTHER; note = uracil
  modified_base 209: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 240: mod_base = OTHER; note = uracil
  modified_base 243: mod_base = OTHER; note = uracil
  modified_base 253: mod_base = OTHER; note = uracil
  modified_base 254: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 300: mod_base = OTHER; note = uracil
ttttggttatgatttagttttttttaggtgatttatttgtatttttttttgttttttaggttattatygagtatgatttatttttagtatyggttgagygaggtttagaagatgattaatttygtggggatttgaggttaggaggtaaaygtgtaaggtggtttatgtttttaatttaatattttgggaggttgaggtaggaggattatttgagtttaggagtttgagattagtttgggtaatatagtgagattaaaaaatataaaaattattygggtatgatagtatatatttgtggtt

SEQ ID NO: 175 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 29: mod_base = OTHER; note = uracil
  modified_base 34: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 59: mod_base = OTHER; note = uracil
  modified_base 60: mod_base = OTHER; note = uracil
  modified_base 66: mod_base = OTHER; note = uracil
  modified_base 75: mod_base = OTHER; note = uracil
  modified_base 83: mod_base = OTHER; note = uracil
  modified_base 87: mod_base = OTHER; note = uracil
  modified_base 96: mod_base = OTHER; note = uracil
  modified_base 97: mod_base = OTHER; note = uracil
  modified_base 102: mod_base = OTHER; note = uracil
  modified_base 107: mod_base = OTHER; note = uracil
  modified_base 114: mod_base = OTHER; note = uracil
  modified_base 124: mod_base = OTHER; note = uracil
  modified_base 128: mod_base = OTHER; note = uracil
  modified_base 129: mod_base = OTHER; note = uracil
  modified_base 136: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 177: mod_base = OTHER; note = uracil
  modified_base 178: mod_base = OTHER; note = uracil
  modified_base 188: mod_base = OTHER; note = uracil
  modified_base 189: mod_base = OTHER; note = uracil
  modified_base 198: mod_base = OTHER; note = uracil
  modified_base 202: mod_base = OTHER; note = uracil
  modified_base 205: mod_base = OTHER; note = uracil
  modified_base 219: mod_base = OTHER; note = uracil
  modified_base 221: mod_base = OTHER; note = uracil
  modified_base 228: mod_base = OTHER; note = uracil
  modified_base 230: mod_base = OTHER; note = uracil
  modified_base 237: mod_base = OTHER; note = uracil
  modified_base 239: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 258: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 289: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 298: mod_base = OTHER; note = uracil
aggaagtygaggtttagaagttgggtgatttgttaaaggtygttatttayggtgagggttaggttttgggagggttgaggggtaggtatggtgagttagtttygggtatgaggtaaggygtggtaggtttgggggtaaaagttatagttygtgtggagggggtggggggatygaggtttttgggaagtttgtggattttggttgtagtgtgggtgtgatattgagtgtttyggggatttygagttattatttaggtattggttagttttaygtttttttttttaggtatttggttttttg

SEQ ID NO: 176 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 14: mod_base = OTHER; note = uracil
  modified_base 15: mod_base = OTHER; note = uracil
  modified_base 35: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 46: mod_base = OTHER; note = uracil
  modified_base 57: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 75: mod_base = OTHER; note = uracil
  modified_base 77: mod_base = OTHER; note = uracil
  modified_base 83: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 153: mod_base = OTHER; note = uracil
  modified_base 159: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 183: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 194: mod_base = OTHER; note = uracil
  modified_base 195: mod_base = OTHER; note = uracil
  modified_base 201: mod_base = OTHER; note = uracil
  modified_base 205: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 237: mod_base = OTHER; note = uracil
  modified_base 238: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 248: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 280: mod_base = OTHER; note = uracil
  modified_base 283: mod_base = OTHER; note = uracil
  modified_base 288: mod_base = OTHER; note = uracil
  modified_base 289: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 300: mod_base = OTHER; note = uracil
agggagttaagtatttggaggagggagygtggggttggttagtgtttgggtgataattyggagttttyggagtatttagtgttatatttatattgtagttagaatttataggttttttaaaggtttygatttttttattttttttataygggttgtggtttttgtttttaggtttgttaygttttgttttatgttyggaattggtttattatgtttgttttttagtttttttagaatttggtttttatygtgggtggygatttttgataagttatttaatttttaagtttygattttttt

SEQ ID NO: 177 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 62: mod_base = OTHER; note = uracil
  modified_base 63: mod_base = OTHER; note = uracil
  modified_base 70: mod_base = OTHER; note = uracil
  modified_base 71: mod_base = OTHER; note = uracil
  modified_base 78: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 89: mod_base = OTHER; note = uracil
  modified_base 91: mod_base = OTHER; note = uracil
  modified_base 98: mod_base = OTHER; note = uracil
  modified_base 99: mod_base = OTHER; note = uracil
  modified_base 105: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 129: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 174: mod_base = OTHER; note = uracil
  modified_base 176: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 198: mod_base = OTHER; note = uracil
  modified_base 203: mod_base = OTHER; note = uracil
  modified_base 208: mod_base = OTHER; note = uracil
  modified_base 214: mod_base = OTHER; note = uracil
  modified_base 215: mod_base = OTHER; note = uracil
  modified_base 222: mod_base = OTHER; note = uracil
  modified_base 223: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 259: mod_base = OTHER; note = uracil
  modified_base 261: mod_base = OTHER; note = uracil
  modified_base 265: mod_base = OTHER; note = uracil
  modified_base 276: mod_base = OTHER; note = uracil
  modified_base 280: mod_base = OTHER; note = uracil
  modified_base 286: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 297: mod_base = OTHER; note = uracil
  modified_base 298: mod_base = OTHER; note = uracil
  modified_base 299: mod_base = OTHER; note = uracil
agttayggygattattaggtttatttttttttattttttttttttgtaggtggttttttggttagtgtgtttgagtgtttattttttgttttagtgttttggtgtttyggtttttttttttttttttatttttttgggtttgggtttgtygttttygggtttttaggtttagatataagggttgaatgattagattgttggtttgtttagtttttatgtggtttyggtttattttagttttggttgtttttttaaagttttaattaygaygagattatatagtaattttgtttttttttt

SEQ ID NO: 178 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 19: mod_base = OTHER; note = uracil
  modified_base 28: mod_base = OTHER; note = uracil
  modified_base 44: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 64: mod_base = OTHER; note = uracil
  modified_base 74: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 91: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 104: mod_base = OTHER; note = uracil
  modified_base 108: mod_base = OTHER; note = uracil
  modified_base 113: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 129: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 143: mod_base = OTHER; note = uracil
  modified_base 153: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 191: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 205: mod_base = OTHER; note = uracil
  modified_base 207: mod_base = OTHER; note = uracil
  modified_base 213: mod_base = OTHER; note = uracil
  modified_base 224: mod_base = OTHER; note = uracil
  modified_base 226: mod_base = OTHER; note = uracil
  modified_base 228: mod_base = OTHER; note = uracil
  modified_base 232: mod_base = OTHER; note = uracil
  modified_base 234: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 282: mod_base = OTHER; note = uracil
  modified_base 283: mod_base = OTHER; note = uracil
  modified_base 293: mod_base = OTHER; note = uracil
  modified_base 299: mod_base = OTHER; note = uracil
agggagggggtagagttattgtatgatttygtygtgattgagattttggggaggtagttagagttggggtgggtygaggttatatggaaattgaatagattagtagtttggttatttaatttttgtgtttagatttggaggttygggagyggtaggtttaggtttaggagagtgaggaggaagaggagagtyggagtattaggatattagagtaagaggtgagtatttaggtatattggttagaaggttatttgtaggaggaggaggtgggggaggatggatttggtggtygtygtggtt

SEQ ID NO: 179 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 21: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 39: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 50: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 105: mod_base = OTHER; note = uracil
  modified_base 108: mod_base = OTHER; note = uracil
  modified_base 112: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 132: mod_base = OTHER; note = uracil
  modified_base 139: mod_base = OTHER; note = uracil
  modified_base 144: mod_base = OTHER; note = uracil
  modified_base 153: mod_base = OTHER; note = uracil
  modified_base 154: mod_base = OTHER; note = uracil
  modified_base 161: mod_base = OTHER; note = uracil
  modified_base 162: mod_base = OTHER; note = uracil
  modified_base 169: mod_base = OTHER; note = uracil
  modified_base 171: mod_base = OTHER; note = uracil
  modified_base 174: mod_base = OTHER; note = uracil
  modified_base 186: mod_base = OTHER; note = uracil
  modified_base 190: mod_base = OTHER; note = uracil
  modified_base 202: mod_base = OTHER; note = uracil
  modified_base 206: mod_base = OTHER; note = uracil
  modified_base 211: mod_base = OTHER; note = uracil
  modified_base 221: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 245: mod_base = OTHER; note = uracil
  modified_base 249: mod_base = OTHER; note = uracil
  modified_base 259: mod_base = OTHER; note = uracil
  modified_base 263: mod_base = OTHER; note = uracil
  modified_base 265: mod_base = OTHER; note = uracil
  modified_base 272: mod_base = OTHER; note = uracil
  modified_base 284: mod_base = OTHER; note = uracil
  modified_base 293: mod_base = OTHER; note = uracil
  modified_base 299: mod_base = OTHER; note = uracil
aaggtgaatgttgtaattttttttttttagttttgtagtygatttttgatataaattttttgaagtttagtggtttttttttatgtatttattatttatatttgttgtttttaaagaaattataatttggatygggaatagaattggaygtgttaaaatgtttgaggatattttatygaatgtggttggtttgatgggaagttggtatgattagaaatgttaggagttttttttttygaggttttaagttttgtgtttttgatttaatggttyggattgagattagatgagttaagttta

SEQ ID NO: 180 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 9: mod_base = OTHER; note = uracil
  modified_base 11: mod_base = OTHER; note = uracil
  modified_base 14: mod_base = OTHER; note = uracil
  modified_base 19: mod_base = OTHER; note = uracil
  modified_base 21: mod_base = OTHER; note = uracil
  modified_base 25: mod_base = OTHER; note = uracil
  modified_base 30: mod_base = OTHER; note = uracil
  modified_base 31: mod_base = OTHER; note = uracil
  modified_base 39: mod_base = OTHER; note = uracil
  modified_base 45: mod_base = OTHER; note = uracil
  modified_base 47: mod_base = OTHER; note = uracil
  modified_base 52: mod_base = OTHER; note = uracil
  modified_base 59: mod_base = OTHER; note = uracil
  modified_base 60: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 86: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 111: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 140: mod_base = OTHER; note = uracil
  modified_base 148: mod_base = OTHER; note = uracil
  modified_base 153: mod_base = OTHER; note = uracil
  modified_base 154: mod_base = OTHER; note = uracil
  modified_base 159: mod_base = OTHER; note = uracil
  modified_base 164: mod_base = OTHER; note = uracil
  modified_base 165: mod_base = OTHER; note = uracil
  modified_base 170: mod_base = OTHER; note = uracil
  modified_base 171: mod_base = OTHER; note = uracil
  modified_base 184: mod_base = OTHER; note = uracil
  modified_base 193: mod_base = OTHER; note = uracil
  modified_base 196: mod_base = OTHER; note = uracil
  modified_base 215: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 235: mod_base = OTHER; note = uracil
  modified_base 238: mod_base = OTHER; note = uracil
  modified_base 252: mod_base = OTHER; note = uracil
  modified_base 262: mod_base = OTHER; note = uracil
  modified_base 265: mod_base = OTHER; note = uracil
  modified_base 270: mod_base = OTHER; note = uracil
  modified_base 287: mod_base = OTHER; note = uracil
  modified_base 290: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gaatttgatttatttgattttaattyggattattgagttagaaatataaagtttgaaatttygagagggaagatttttgatatttttagttatgttagttttttattaagttagttatattygatgaagtgtttttaggtattttggtaygtttagttttgttttyggtttaggttgtggtttttttgaaagtagtaggtgtaggtggtaggtgtatggaaagaggttattgaattttaaggagtttatgttagggatyggttgtagggttgaggagagagggttgtagtatttattttt

SEQ ID NO: 181 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 9: mod_base = OTHER; note = uracil
  modified_base 12: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 23: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 81: mod_base = OTHER; note = uracil
  modified_base 85: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 105: mod_base = OTHER; note = uracil
  modified_base 112: mod_base = OTHER; note = uracil
  modified_base 117: mod_base = OTHER; note = uracil
  modified_base 126: mod_base = OTHER; note = uracil
  modified_base 127: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 144: mod_base = OTHER; note = uracil
  modified_base 147: mod_base = OTHER; note = uracil
  modified_base 159: mod_base = OTHER; note = uracil
  modified_base 163: mod_base = OTHER; note = uracil
  modified_base 175: mod_base = OTHER; note = uracil
  modified_base 179: mod_base = OTHER; note = uracil
  modified_base 184: mod_base = OTHER; note = uracil
  modified_base 194: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 218: mod_base = OTHER; note = uracil
  modified_base 222: mod_base = OTHER; note = uracil
  modified_base 232: mod_base = OTHER; note = uracil
  modified_base 236: mod_base = OTHER; note = uracil
  modified_base 238: mod_base = OTHER; note = uracil
  modified_base 245: mod_base = OTHER; note = uracil
  modified_base 257: mod_base = OTHER; note = uracil
  modified_base 266: mod_base = OTHER; note = uracil
  modified_base 272: mod_base = OTHER; note = uracil
  modified_base 279: mod_base = OTHER; note = uracil
  modified_base 280: mod_base = OTHER; note = uracil
  modified_base 284: mod_base = OTHER; note = uracil
  modified_base 288: mod_base = OTHER; note = uracil
  modified_base 289: mod_base = OTHER; note = uracil
tagttttgtagtygatttttgatataaattttttgaagtttagtggtttttttttatgtatttattatttatatttgttgtttttaaagaaattataatttggatygggaatagaattggaygtgttaaaatgtttgaggatattttatygaatgtggttggtttgatgggaagttggtatgattagaaatgttaggagttttttttttygaggttttaagttttgtgtttttgatttaatggttyggattgagattagatgagttaagtttagatgattatgtaaatttttagatgggg

SEQ ID NO: 182 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 18: mod_base = OTHER; note = uracil
  modified_base 24: mod_base = OTHER; note = uracil
  modified_base 27: mod_base = OTHER; note = uracil
  modified_base 32: mod_base = OTHER; note = uracil
  modified_base 37: mod_base = OTHER; note = uracil
  modified_base 39: mod_base = OTHER; note = uracil
  modified_base 42: mod_base = OTHER; note = uracil
  modified_base 47: mod_base = OTHER; note = uracil
  modified_base 49: mod_base = OTHER; note = uracil
  modified_base 53: mod_base = OTHER; note = uracil
  modified_base 58: mod_base = OTHER; note = uracil
  modified_base 59: mod_base = OTHER; note = uracil
  modified_base 67: mod_base = OTHER; note = uracil
  modified_base 73: mod_base = OTHER; note = uracil
  modified_base 75: mod_base = OTHER; note = uracil
  modified_base 80: mod_base = OTHER; note = uracil
  modified_base 87: mod_base = OTHER; note = uracil
  modified_base 88: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 109: mod_base = OTHER; note = uracil
  modified_base 114: mod_base = OTHER; note = uracil
  modified_base 119: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 168: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 187: mod_base = OTHER; note = uracil
  modified_base 192: mod_base = OTHER; note = uracil
  modified_base 193: mod_base = OTHER; note = uracil
  modified_base 198: mod_base = OTHER; note = uracil
  modified_base 199: mod_base = OTHER; note = uracil
  modified_base 212: mod_base = OTHER; note = uracil
  modified_base 221: mod_base = OTHER; note = uracil
  modified_base 224: mod_base = OTHER; note = uracil
  modified_base 243: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 263: mod_base = OTHER; note = uracil
  modified_base 266: mod_base = OTHER; note = uracil
  modified_base 280: mod_base = OTHER; note = uracil
  modified_base 290: mod_base = OTHER; note = uracil
  modified_base 293: mod_base = OTHER; note = uracil
  modified_base 298: mod_base = OTHER; note = uracil
ttttatttaaaggtttgtatggttatttgaatttgatttatttgattttaattyggattattgagttagaaatataaagtttgaaatttygagagggaagatttttgatatttttagttatgttagttttttattaagttagttatattygatgaagtgtttttaggtattttggtaygtttagttttgttttyggtttaggttgtggtttttttgaaagtagtaggtgtaggtggtaggtgtatggaaagaggttattgaattttaaggagtttatgttagggatyggttgtagggttg

SEQ ID NO: 183 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 21: mod_base = OTHER; note = uracil
  modified_base 25: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 52: mod_base = OTHER; note = uracil
  modified_base 57: mod_base = OTHER; note = uracil
  modified_base 66: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 82: mod_base = OTHER; note = uracil
  modified_base 84: mod_base = OTHER; note = uracil
  modified_base 87: mod_base = OTHER; note = uracil
  modified_base 99: mod_base = OTHER; note = uracil
  modified_base 103: mod_base = OTHER; note = uracil
  modified_base 115: mod_base = OTHER; note = uracil
  modified_base 119: mod_base = OTHER; note = uracil
  modified_base 124: mod_base = OTHER; note = uracil
  modified_base 134: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 158: mod_base = OTHER; note = uracil
  modified_base 162: mod_base = OTHER; note = uracil
  modified_base 172: mod_base = OTHER; note = uracil
  modified_base 176: mod_base = OTHER; note = uracil
  modified_base 178: mod_base = OTHER; note = uracil
  modified_base 185: mod_base = OTHER; note = uracil
  modified_base 197: mod_base = OTHER; note = uracil
  modified_base 206: mod_base = OTHER; note = uracil
  modified_base 212: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 228: mod_base = OTHER; note = uracil
  modified_base 229: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 249: mod_base = OTHER; note = uracil
  modified_base 254: mod_base = OTHER; note = uracil
  modified_base 261: mod_base = OTHER; note = uracil
  modified_base 263: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 273: mod_base = OTHER; note = uracil
  modified_base 283: mod_base = OTHER; note = uracil
  modified_base 286: mod_base = OTHER; note = uracil
  modified_base 288: mod_base = OTHER; note = uracil
  modified_base 289: mod_base = OTHER; note = uracil
tttattatttatatttgttgtttttaaagaaattataatttggatygggaatagaattggaygtgttaaaatgtttgaggatattttatygaatgtggttggtttgatgggaagttggtatgattagaaatgttaggagttttttttttygaggttttaagttttgtgtttttgatttaatggttyggattgagattagatgagttaagtttagatgattatgtaaatttttagatggggtttaaaattaaatttgtgtttttaaattattttaaatgtgtttattattagttatagttt

SEQ ID NO: 184 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 10: mod_base = OTHER; note = uracil
  modified_base 21: mod_base = OTHER; note = uracil
  modified_base 23: mod_base = OTHER; note = uracil
  modified_base 43: mod_base = OTHER; note = uracil
  modified_base 45: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 78: mod_base = OTHER; note = uracil
  modified_base 84: mod_base = OTHER; note = uracil
  modified_base 87: mod_base = OTHER; note = uracil
  modified_base 92: mod_base = OTHER; note = uracil
  modified_base 97: mod_base = OTHER; note = uracil
  modified_base 99: mod_base = OTHER; note = uracil
  modified_base 102: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 118: mod_base = OTHER; note = uracil
  modified_base 119: mod_base = OTHER; note = uracil
  modified_base 127: mod_base = OTHER; note = uracil
  modified_base 133: mod_base = OTHER; note = uracil
  modified_base 135: mod_base = OTHER; note = uracil
  modified_base 140: mod_base = OTHER; note = uracil
  modified_base 147: mod_base = OTHER; note = uracil
  modified_base 148: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 174: mod_base = OTHER; note = uracil
  modified_base 179: mod_base = OTHER; note = uracil
  modified_base 183: mod_base = OTHER; note = uracil
  modified_base 184: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 195: mod_base = OTHER; note = uracil
  modified_base 199: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 228: mod_base = OTHER; note = uracil
  modified_base 236: mod_base = OTHER; note = uracil
  modified_base 241: mod_base = OTHER; note = uracil
  modified_base 242: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 258: mod_base = OTHER; note = uracil
  modified_base 259: mod_base = OTHER; note = uracil
  modified_base 272: mod_base = OTHER; note = uracil
  modified_base 281: mod_base = OTHER; note = uracil
  modified_base 284: mod_base = OTHER; note = uracil
aaattataattggtgatgaatatatttggaatggtttgagaatatagatttggttttaggttttatttaaaggtttgtatggttatttgaatttgatttatttgattttaattyggattattgagttagaaatataaagtttgaaatttygagagggaagatttttgatatttttagttatgttagttttttattaagttagttatattygatgaagtgtttttaggtattttggtaygtttagttttgttttyggtttaggttgtggtttttttgaaagtagtaggtgtaggtggtagg

SEQ ID NO: 185 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 19: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 45: mod_base = OTHER; note = uracil
  modified_base 50: mod_base = OTHER; note = uracil
  modified_base 51: mod_base = OTHER; note = uracil
  modified_base 54: mod_base = OTHER; note = uracil
  modified_base 55: mod_base = OTHER; note = uracil
  modified_base 62: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 78: mod_base = OTHER; note = uracil
  modified_base 79: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 99: mod_base = OTHER; note = uracil
  modified_base 106: mod_base = OTHER; note = uracil
  modified_base 111: mod_base = OTHER; note = uracil
  modified_base 114: mod_base = OTHER; note = uracil
  modified_base 123: mod_base = OTHER; note = uracil
  modified_base 127: mod_base = OTHER; note = uracil
  modified_base 134: mod_base = OTHER; note = uracil
  modified_base 146: mod_base = OTHER; note = uracil
  modified_base 147: mod_base = OTHER; note = uracil
  modified_base 157: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 166: mod_base = OTHER; note = uracil
  modified_base 176: mod_base = OTHER; note = uracil
  modified_base 180: mod_base = OTHER; note = uracil
  modified_base 189: mod_base = OTHER; note = uracil
  modified_base 193: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 217: mod_base = OTHER; note = uracil
  modified_base 230: mod_base = OTHER; note = uracil
  modified_base 231: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 254: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 295: mod_base = OTHER; note = uracil
gagaggggaaggggtygattatttgttttygagttattttygggttyggttagttattgggttgggaatttgttaattttggttgattttttaatgagttgtgaattggtttttygggaggatttataggaggttggaaayggggtttggygygygttttttttttagtgygaggttgattggttggattygtygggttttattgtgggttttaygttatgtttagaygttygaygtgttttattttattgaattygttttgttttttaagtagggaygatttatttttattttttagat

SEQ ID NO: 186 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 39: mod_base = OTHER; note = uracil
  modified_base 50: mod_base = OTHER; note = uracil
  modified_base 63: mod_base = OTHER; note = uracil
  modified_base 75: mod_base = OTHER; note = uracil
  modified_base 80: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 104: mod_base = OTHER; note = uracil
  modified_base 105: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 131: mod_base = OTHER; note = uracil
  modified_base 133: mod_base = OTHER; note = uracil
  modified_base 151: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 164: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 192: mod_base = OTHER; note = uracil
  modified_base 193: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 205: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 229: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 268: mod_base = OTHER; note = uracil
  modified_base 276: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 296: mod_base = OTHER; note = uracil
  modified_base 298: mod_base = OTHER; note = uracil
  modified_base 300: mod_base = OTHER; note = uracil
atttagaaaatggaggtaaatygtttttatttggggggtaggaygagtttaataaaatgggataygtygggygtttaaatatagygtggggtttatagtagagttyggygagtttaattagttagtttygtattgagagggaagygygygttaggtttygtttttagttttttgtaagttttttyggaagattagtttatagtttattggaagattaattaggattgataggtttttagtttaatggttggtygagttygagaatggttygggagtaggtggtyggtttttttttttttt

SEQ ID NO: 187 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 23: mod_base = OTHER; note = uracil
  modified_base 25: mod_base = OTHER; note = uracil
  modified_base 34: mod_base = OTHER; note = uracil
  modified_base 39: mod_base = OTHER; note = uracil
  modified_base 42: mod_base = OTHER; note = uracil
  modified_base 45: mod_base = OTHER; note = uracil
  modified_base 53: mod_base = OTHER; note = uracil
  modified_base 58: mod_base = OTHER; note = uracil
  modified_base 63: mod_base = OTHER; note = uracil
  modified_base 73: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 95: mod_base = OTHER; note = uracil
  modified_base 105: mod_base = OTHER; note = uracil
  modified_base 112: mod_base = OTHER; note = uracil
  modified_base 118: mod_base = OTHER; note = uracil
  modified_base 134: mod_base = OTHER; note = uracil
  modified_base 137: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 150: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 246: mod_base = OTHER; note = uracil
  modified_base 251: mod_base = OTHER; note = uracil
  modified_base 259: mod_base = OTHER; note = uracil
  modified_base 272: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 289: mod_base = OTHER; note = uracil
ygggggtagggagtagatttgatttagtggygttagtgttattttaaagyggtagygtattttattaaaaatttgatgtagaaattattttgggttttgttttgtaaagagtatttgtataagaaaaaataattagtyggttaattttttygtttattggtaggaagagagatagtttttagagagtttgggatttttttattttyggagaattaaaagttttygagatatttattttagaagttttggttaatygtttttaaagtgyggttagaagattttttgygtttgaatggtttg

SEQ ID NO: 188 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 16: mod_base = OTHER; note = uracil
  modified_base 24: mod_base = OTHER; note = uracil
  modified_base 27: mod_base = OTHER; note = uracil
  modified_base 31: mod_base = OTHER; note = uracil
  modified_base 34: mod_base = OTHER; note = uracil
  modified_base 36: mod_base = OTHER; note = uracil
  modified_base 52: mod_base = OTHER; note = uracil
  modified_base 53: mod_base = OTHER; note = uracil
  modified_base 58: mod_base = OTHER; note = uracil
  modified_base 61: mod_base = OTHER; note = uracil
  modified_base 74: mod_base = OTHER; note = uracil
  modified_base 82: mod_base = OTHER; note = uracil
  modified_base 91: mod_base = OTHER; note = uracil
  modified_base 93: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 115: mod_base = OTHER; note = uracil
  modified_base 117: mod_base = OTHER; note = uracil
  modified_base 119: mod_base = OTHER; note = uracil
  modified_base 126: mod_base = OTHER; note = uracil
  modified_base 130: mod_base = OTHER; note = uracil
  modified_base 132: mod_base = OTHER; note = uracil
  modified_base 134: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 161: mod_base = OTHER; note = uracil
  modified_base 165: mod_base = OTHER; note = uracil
  modified_base 178: mod_base = OTHER; note = uracil
  modified_base 184: mod_base = OTHER; note = uracil
  modified_base 190: mod_base = OTHER; note = uracil
  modified_base 192: mod_base = OTHER; note = uracil
  modified_base 197: mod_base = OTHER; note = uracil
  modified_base 202: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 220: mod_base = OTHER; note = uracil
  modified_base 223: mod_base = OTHER; note = uracil
  modified_base 226: mod_base = OTHER; note = uracil
  modified_base 246: mod_base = OTHER; note = uracil
  modified_base 249: mod_base = OTHER; note = uracil
  modified_base 252: mod_base = OTHER; note = uracil
  modified_base 263: mod_base = OTHER; note = uracil
  modified_base 265: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 280: mod_base = OTHER; note = uracil
  modified_base 285: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 298: mod_base = OTHER; note = uracil
taaattatttagaygtaaggggttttttgatygtattttaagaaygattgattagaatttttaaaatggatgtttyggaggtttttaatttttygggaatgagagagttttaaattttttgaaggttgtttttttttttgttagtggaygggggaattaatyggttgattatttttttttatgtaaatgttttttgtaaaataaagtttagggtaatttttatattagatttttaatgaaatgygttgtygttttgaagtagtattgaygttattgagttaggtttgttttttgttttyg

SEQ ID NO: 189 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 13: mod_base = OTHER; note = uracil
  modified_base 14: mod_base = OTHER; note = uracil
  modified_base 25: mod_base = OTHER; note = uracil
  modified_base 49: mod_base = OTHER; note = uracil
  modified_base 50: mod_base = OTHER; note = uracil
  modified_base 54: mod_base = OTHER; note = uracil
  modified_base 56: mod_base = OTHER; note = uracil
  modified_base 62: mod_base = OTHER; note = uracil
  modified_base 66: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 126: mod_base = OTHER; note = uracil
  modified_base 128: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 179: mod_base = OTHER; note = uracil
  modified_base 185: mod_base = OTHER; note = uracil
  modified_base 186: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 205: mod_base = OTHER; note = uracil
  modified_base 211: mod_base = OTHER; note = uracil
  modified_base 215: mod_base = OTHER; note = uracil
  modified_base 217: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 230: mod_base = OTHER; note = uracil
  modified_base 233: mod_base = OTHER; note = uracil
  modified_base 240: mod_base = OTHER; note = uracil
  modified_base 244: mod_base = OTHER; note = uracil
  modified_base 247: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 263: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 287: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 297: mod_base = OTHER; note = uracil
tagtgttgtagatttattaattattaggataattayggayggggaaatttagatatagatataattagtgtttttttttattttttygtataygtttttttyggtttttttgatattttggtgtgtattgtgtttttttgttatttttaygttgyggtttttattagatttatttttgtyggtgttaaaatgtttaaaggaaggttgagttatgttttggtttgtttagtygtaatagttatgttgtaatttttayggaaaatttttttttatttattttagaggtttgagatattttaa

SEQ ID NO: 190 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 12: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 43: mod_base = OTHER; note = uracil
  modified_base 55: mod_base = OTHER; note = uracil
  modified_base 58: mod_base = OTHER; note = uracil
  modified_base 63: mod_base = OTHER; note = uracil
  modified_base 72: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 87: mod_base = OTHER; note = uracil
  modified_base 92: mod_base = OTHER; note = uracil
  modified_base 94: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 109: mod_base = OTHER; note = uracil
  modified_base 117: mod_base = OTHER; note = uracil
  modified_base 119: mod_base = OTHER; note = uracil
  modified_base 123: mod_base = OTHER; note = uracil
  modified_base 134: mod_base = OTHER; note = uracil
  modified_base 144: mod_base = OTHER; note = uracil
  modified_base 147: mod_base = OTHER; note = uracil
  modified_base 161: mod_base = OTHER; note = uracil
  modified_base 169: mod_base = OTHER; note = uracil
  modified_base 171: mod_base = OTHER; note = uracil
  modified_base 176: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 189: mod_base = OTHER; note = uracil
  modified_base 197: mod_base = OTHER; note = uracil
  modified_base 231: mod_base = OTHER; note = uracil
  modified_base 233: mod_base = OTHER; note = uracil
  modified_base 243: mod_base = OTHER; note = uracil
  modified_base 249: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 263: mod_base = OTHER; note = uracil
  modified_base 273: mod_base = OTHER; note = uracil
  modified_base 274: mod_base = OTHER; note = uracil
  modified_base 290: mod_base = OTHER; note = uracil
  modified_base 293: mod_base = OTHER; note = uracil
  modified_base 296: mod_base = OTHER; note = uracil
  modified_base 298: mod_base = OTHER; note = uracil
ttagggtgttttagatttttggagtgggtgaaaggaggtttttygtgggagttgtagtatgattattgyggttgggtaggttagagtatgatttagtttttttttgggtattttggtatyggtaggggtgggtttagtaggagtygtagygtggagatggtaggggaatatagtgtatattaggatgttagggagatygggaggggygtgtgyggggaggtggaggagggtattgattgtatttgtgtttggattttttygttygtaattattttgataattaataggtttataatattg

SEQ ID NO: 191 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 16: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 37: mod_base = OTHER; note = uracil
  modified_base 38: mod_base = OTHER; note = uracil
  modified_base 49: mod_base = OTHER; note = uracil
  modified_base 51: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 75: mod_base = OTHER; note = uracil
  modified_base 79: mod_base = OTHER; note = uracil
  modified_base 81: mod_base = OTHER; note = uracil
  modified_base 88: mod_base = OTHER; note = uracil
  modified_base 91: mod_base = OTHER; note = uracil
  modified_base 95: mod_base = OTHER; note = uracil
  modified_base 116: mod_base = OTHER; note = uracil
  modified_base 122: mod_base = OTHER; note = uracil
  modified_base 126: mod_base = OTHER; note = uracil
  modified_base 129: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 143: mod_base = OTHER; note = uracil
  modified_base 148: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 158: mod_base = OTHER; note = uracil
  modified_base 163: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 173: mod_base = OTHER; note = uracil
  modified_base 182: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 231: mod_base = OTHER; note = uracil
  modified_base 232: mod_base = OTHER; note = uracil
  modified_base 236: mod_base = OTHER; note = uracil
  modified_base 242: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 254: mod_base = OTHER; note = uracil
  modified_base 260: mod_base = OTHER; note = uracil
  modified_base 263: mod_base = OTHER; note = uracil
  modified_base 268: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 291: mod_base = OTHER; note = uracil
ggaaggagygagtttttttttataggagttttagtttttygttttgtttttttygggttattttttaaagaaagtyggtttttgagttagttggtaggagagygaggygaatgygttggtgttggtygtaatggtttyggtttaaygttygttttagttggttaygtttttatyggggyggtyggyggtttgtttgtttaygttttgttaggagtttaggttagtttttgtttygtyggggtyggagttygtttaaaattaataagttttttgtgttttttttttggaygttgtataatt

SEQ ID NO: 192 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 14: mod_base = OTHER; note = uracil
  modified_base 15: mod_base = OTHER; note = uracil
  modified_base 26: mod_base = OTHER; note = uracil
  modified_base 28: mod_base = OTHER; note = uracil
  modified_base 35: mod_base = OTHER; note = uracil
  modified_base 54: mod_base = OTHER; note = uracil
  modified_base 56: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 71: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 105: mod_base = OTHER; note = uracil
  modified_base 109: mod_base = OTHER; note = uracil
  modified_base 113: mod_base = OTHER; note = uracil
  modified_base 116: mod_base = OTHER; note = uracil
  modified_base 120: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 161: mod_base = OTHER; note = uracil
  modified_base 167: mod_base = OTHER; note = uracil
  modified_base 168: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 188: mod_base = OTHER; note = uracil
  modified_base 194: mod_base = OTHER; note = uracil
  modified_base 195: mod_base = OTHER; note = uracil
  modified_base 199: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 215: mod_base = OTHER; note = uracil
  modified_base 217: mod_base = OTHER; note = uracil
  modified_base 223: mod_base = OTHER; note = uracil
  modified_base 227: mod_base = OTHER; note = uracil
  modified_base 231: mod_base = OTHER; note = uracil
  modified_base 244: mod_base = OTHER; note = uracil
  modified_base 245: mod_base = OTHER; note = uracil
  modified_base 255: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 289: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 299: mod_base = OTHER; note = uracil
  modified_base 300: mod_base = OTHER; note = uracil
aattatatagygtttaaaggagaggtataaaagatttgttgattttggaygggtttyggtttyggygaggtaagggttgatttgggtttttggtagagygtgggtaggtaggtygtyggtygtttyggtgaggaygtgattagttggagygagygttgaatyggggttattgyggttagtattagygtattygtttygtttttttgttagttgatttaagagtyggttttttttggagaataattygaagagaataaaaygaggaattggagtttttataaaaagaagttygtttttttt

SEQ ID NO: 193 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 21: mod_base = OTHER; note = uracil
  modified_base 23: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 42: mod_base = OTHER; note = uracil
  modified_base 52: mod_base = OTHER; note = uracil
  modified_base 55: mod_base = OTHER; note = uracil
  modified_base 61: mod_base = OTHER; note = uracil
  modified_base 63: mod_base = OTHER; note = uracil
  modified_base 86: mod_base = OTHER; note = uracil
  modified_base 90: mod_base = OTHER; note = uracil
  modified_base 106: mod_base = OTHER; note = uracil
  modified_base 107: mod_base = OTHER; note = uracil
  modified_base 114: mod_base = OTHER; note = uracil
  modified_base 117: mod_base = OTHER; note = uracil
  modified_base 148: mod_base = OTHER; note = uracil
  modified_base 154: mod_base = OTHER; note = uracil
  modified_base 158: mod_base = OTHER; note = uracil
  modified_base 159: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 182: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 204: mod_base = OTHER; note = uracil
  modified_base 221: mod_base = OTHER; note = uracil
  modified_base 225: mod_base = OTHER; note = uracil
  modified_base 229: mod_base = OTHER; note = uracil
  modified_base 231: mod_base = OTHER; note = uracil
  modified_base 234: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 261: mod_base = OTHER; note = uracil
  modified_base 271: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 286: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 298: mod_base = OTHER; note = uracil
  modified_base 299: mod_base = OTHER; note = uracil
ttggttgtggaaggagygagtttttygttttygggagtatgtaagtttgggttgtaygattatttggaagggattgggyggagttttgttatttggagaaagggttttgggagttttaggtttgtgtagggygaggayggggyggttttgygttyggttaggttggttttygaggatttagtygtttttaattttttaaattgttgtyggatgtagaagattygtatttattgttttttatagtyggtgaagggagaaygtygaaaagggtygtatttttttttgtyggttttttttttt

SEQ ID NO: 194 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 16: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 54: mod_base = OTHER; note = uracil
  modified_base 58: mod_base = OTHER; note = uracil
  modified_base 68: mod_base = OTHER; note = uracil
  modified_base 82: mod_base = OTHER; note = uracil
  modified_base 85: mod_base = OTHER; note = uracil
  modified_base 88: mod_base = OTHER; note = uracil
  modified_base 91: mod_base = OTHER; note = uracil
  modified_base 95: mod_base = OTHER; note = uracil
  modified_base 98: mod_base = OTHER; note = uracil
  modified_base 120: mod_base = OTHER; note = uracil
  modified_base 126: mod_base = OTHER; note = uracil
  modified_base 127: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 144: mod_base = OTHER; note = uracil
  modified_base 151: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 165: mod_base = OTHER; note = uracil
  modified_base 166: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 213: mod_base = OTHER; note = uracil
  modified_base 218: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 260: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 281: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 297: mod_base = OTHER; note = uracil
  modified_base 298: mod_base = OTHER; note = uracil
aggggaggggatyggtaggagggaatgyggtttttttyggygttttttttttatygattgtggagagtagtgaatgygagttttttatattygatagtagtttaggaggttggggayggttgggttttygagggttaatttggtyggaygtagaatygtttygttttygttttatataaatttgaagtttttaggattttttttttaaatgatagaatttygtttaattttttttaagtgatygtgtagtttaaatttgtatattttyggggayggagagttygttttttttataattag

SEQ ID NO: 195 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 90: mod_base = OTHER; note = uracil
  modified_base 95: mod_base = OTHER; note = uracil
  modified_base 96: mod_base = OTHER; note = uracil
  modified_base 106: mod_base = OTHER; note = uracil
  modified_base 107: mod_base = OTHER; note = uracil
  modified_base 115: mod_base = OTHER; note = uracil
  modified_base 119: mod_base = OTHER; note = uracil
  modified_base 121: mod_base = OTHER; note = uracil
  modified_base 123: mod_base = OTHER; note = uracil
  modified_base 135: mod_base = OTHER; note = uracil
  modified_base 137: mod_base = OTHER; note = uracil
  modified_base 143: mod_base = OTHER; note = uracil
  modified_base 145: mod_base = OTHER; note = uracil
  modified_base 150: mod_base = OTHER; note = uracil
  modified_base 163: mod_base = OTHER; note = uracil
  modified_base 166: mod_base = OTHER; note = uracil
  modified_base 171: mod_base = OTHER; note = uracil
  modified_base 173: mod_base = OTHER; note = uracil
  modified_base 176: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 189: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 199: mod_base = OTHER; note = uracil
  modified_base 213: mod_base = OTHER; note = uracil
  modified_base 218: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 264: mod_base = OTHER; note = uracil
  modified_base 268: mod_base = OTHER; note = uracil
  modified_base 274: mod_base = OTHER; note = uracil
  modified_base 286: mod_base = OTHER; note = uracil
  modified_base 300: mod_base = OTHER; note = uracil
gggtgttaggttatttttgaagggatttattttttttagttattgttattggatttttttttagtttttttagtaaagtagttttaatgtatgttttgagattgtttyggaaaattgttatttagaggggaagatttttgggtatagagtygttatttataatagtaagatattgtaggttgtttaaatattttaygatagagatgayggagtaatttayggtatttttgttaagagagtattatatagttattaaaaatgattaagtagagatyggtagtgaygttgagtaatgttttt

SEQ ID NO: 196 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 11: mod_base = OTHER; note = uracil
  modified_base 13: mod_base = OTHER; note = uracil
  modified_base 19: mod_base = OTHER; note = uracil
  modified_base 21: mod_base = OTHER; note = uracil
  modified_base 24: mod_base = OTHER; note = uracil
  modified_base 29: mod_base = OTHER; note = uracil
  modified_base 31: mod_base = OTHER; note = uracil
  modified_base 34: mod_base = OTHER; note = uracil
  modified_base 40: mod_base = OTHER; note = uracil
  modified_base 52: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 79: mod_base = OTHER; note = uracil
  modified_base 89: mod_base = OTHER; note = uracil
  modified_base 91: mod_base = OTHER; note = uracil
  modified_base 95: mod_base = OTHER; note = uracil
  modified_base 98: mod_base = OTHER; note = uracil
  modified_base 100: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 126: mod_base = OTHER; note = uracil
  modified_base 132: mod_base = OTHER; note = uracil
  modified_base 136: mod_base = OTHER; note = uracil
  modified_base 152: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 184: mod_base = OTHER; note = uracil
  modified_base 191: mod_base = OTHER; note = uracil
  modified_base 197: mod_base = OTHER; note = uracil
  modified_base 201: mod_base = OTHER; note = uracil
  modified_base 203: mod_base = OTHER; note = uracil
  modified_base 208: mod_base = OTHER; note = uracil
  modified_base 212: mod_base = OTHER; note = uracil
  modified_base 220: mod_base = OTHER; note = uracil
  modified_base 223: mod_base = OTHER; note = uracil
  modified_base 228: mod_base = OTHER; note = uracil
  modified_base 237: mod_base = OTHER; note = uracil
  modified_base 249: mod_base = OTHER; note = uracil
  modified_base 250: mod_base = OTHER; note = uracil
  modified_base 256: mod_base = OTHER; note = uracil
  modified_base 262: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 291: mod_base = OTHER; note = uracil
  modified_base 292: mod_base = OTHER; note = uracil
  modified_base 296: mod_base = OTHER; note = uracil
  modified_base 298: mod_base = OTHER; note = uracil
  modified_base 299: mod_base = OTHER; note = uracil
  modified_base 300: mod_base = OTHER; note = uracil
gaaaatattatttagygttattatyggtttttgtttgattatttttaatggttgtgtaatatttttttggtaggggtgtygtgaattgtttygttatttttgtygtggagtgtttaggtagtttgtagtgttttgttgttataaataayggttttgtgtttaagagtttttttttttgagtgatagtttttygggataattttaggatatgtattggggttgttttgttagaggggttgagggagggtttagtggtagtggttggaggaggtaggtttttttaagggtagtttgatattt

SEQ ID NO: 197 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 6: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 95: mod_base = OTHER; note = uracil
  modified_base 103: mod_base = OTHER; note = uracil
  modified_base 105: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 161: mod_base = OTHER; note = uracil
  modified_base 172: mod_base = OTHER; note = uracil
  modified_base 175: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 198: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 238: mod_base = OTHER; note = uracil
  modified_base 240: mod_base = OTHER; note = uracil
  modified_base 242: mod_base = OTHER; note = uracil
  modified_base 247: mod_base = OTHER; note = uracil
  modified_base 254: mod_base = OTHER; note = uracil
  modified_base 260: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 274: mod_base = OTHER; note = uracil
  modified_base 278: mod_base = OTHER; note = uracil
  modified_base 286: mod_base = OTHER; note = uracil
gtttatygyggagggtttttttattttttttatttttattggtttatttagggtattattattttttttaggaaattttttttgttttttatttttgggtgttttatattttgggtatttatagttagaattttattttygggtttttygtttttagtggttgagtaggagttttagttttaggagatttttttgagtagaatygatttttttttatttttttaatttttatttatatatttaggattgggtatyggggtttgttttaatttgtaggtttagagttaggggttagggtgg

SEQ ID NO: 198 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 5: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 16: mod_base = OTHER; note = uracil
  modified_base 18: mod_base = OTHER; note = uracil
  modified_base 23: mod_base = OTHER; note = uracil
  modified_base 24: mod_base = OTHER; note = uracil
  modified_base 27: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 55: mod_base = OTHER; note = uracil
  modified_base 56: mod_base = OTHER; note = uracil
  modified_base 100: mod_base = OTHER; note = uracil
  modified_base 103: mod_base = OTHER; note = uracil
  modified_base 105: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 123: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 157: mod_base = OTHER; note = uracil
  modified_base 158: mod_base = OTHER; note = uracil
  modified_base 172: mod_base = OTHER; note = uracil
  modified_base 176: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 216: mod_base = OTHER; note = uracil
  modified_base 228: mod_base = OTHER; note = uracil
  modified_base 229: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 258: mod_base = OTHER; note = uracil
  modified_base 259: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 299: mod_base = OTHER; note = uracil
tattttaatttttgattttaagtttgtaaattggggtaggtttyggtatttagttttgagtgtgtgggtgggggttgggaagatgaagaggggtyggttttgtttaggggagttttttaaaattgaagtttttatttagttattggaaayggagggttyggaggtggggttttggttgtaggtgtttagggtgtgagatatttagagatagggggtagggagggttttttggaggaggtggtggtgttttgggtgagttagtgaggatgaggaggataggggggtttttygyggtgggta

SEQ ID NO: 199 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 16: mod_base = OTHER; note = uracil
  modified_base 23: mod_base = OTHER; note = uracil
  modified_base 26: mod_base = OTHER; note = uracil
  modified_base 28: mod_base = OTHER; note = uracil
  modified_base 31: mod_base = OTHER; note = uracil
  modified_base 48: mod_base = OTHER; note = uracil
  modified_base 55: mod_base = OTHER; note = uracil
  modified_base 62: mod_base = OTHER; note = uracil
  modified_base 73: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 107: mod_base = OTHER; note = uracil
  modified_base 109: mod_base = OTHER; note = uracil
  modified_base 112: mod_base = OTHER; note = uracil
  modified_base 116: mod_base = OTHER; note = uracil
  modified_base 120: mod_base = OTHER; note = uracil
  modified_base 125: mod_base = OTHER; note = uracil
  modified_base 126: mod_base = OTHER; note = uracil
  modified_base 134: mod_base = OTHER; note = uracil
  modified_base 136: mod_base = OTHER; note = uracil
  modified_base 140: mod_base = OTHER; note = uracil
  modified_base 145: mod_base = OTHER; note = uracil
  modified_base 146: mod_base = OTHER; note = uracil
  modified_base 161: mod_base = OTHER; note = uracil
  modified_base 163: mod_base = OTHER; note = uracil
  modified_base 169: mod_base = OTHER; note = uracil
  modified_base 180: mod_base = OTHER; note = uracil
  modified_base 182: mod_base = OTHER; note = uracil
  modified_base 191: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 246: mod_base = OTHER; note = uracil
  modified_base 249: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 267: mod_base = OTHER; note = uracil
  modified_base 274: mod_base = OTHER; note = uracil
  modified_base 285: mod_base = OTHER; note = uracil
  modified_base 287: mod_base = OTHER; note = uracil
  modified_base 288: mod_base = OTHER; note = uracil
tttaaatgagaagaatatgtttttatatygtatttgtgaaagtttggttyggagttaygygttgattaatattagattttttttattygtttygttataattttgttatatttggttgataaatttygaggaatttyggtaaagttaggyggyggyggggtttygggtttgggyggyggtttyggaggagtagygggagatttygtagyggtttttttttttttygttygyggtttttagtttygtygtygtygttyggtttttagtayggaatygayggggygttttygagaygggyga

SEQ ID NO: 200 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 9: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 30: mod_base = OTHER; note = uracil
  modified_base 35: mod_base = OTHER; note = uracil
  modified_base 42: mod_base = OTHER; note = uracil
  modified_base 61: mod_base = OTHER; note = uracil
  modified_base 68: mod_base = OTHER; note = uracil
  modified_base 90: mod_base = OTHER; note = uracil
  modified_base 93: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 122: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 134: mod_base = OTHER; note = uracil
  modified_base 135: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 157: mod_base = OTHER; note = uracil
  modified_base 162: mod_base = OTHER; note = uracil
  modified_base 170: mod_base = OTHER; note = uracil
  modified_base 171: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 196: mod_base = OTHER; note = uracil
  modified_base 226: mod_base = OTHER; note = uracil
  modified_base 237: mod_base = OTHER; note = uracil
  modified_base 247: mod_base = OTHER; note = uracil
  modified_base 249: mod_base = OTHER; note = uracil
  modified_base 254: mod_base = OTHER; note = uracil
  modified_base 255: mod_base = OTHER; note = uracil
  modified_base 259: mod_base = OTHER; note = uracil
  modified_base 263: mod_base = OTHER; note = uracil
  modified_base 265: mod_base = OTHER; note = uracil
  modified_base 282: mod_base = OTHER; note = uracil
  modified_base 288: mod_base = OTHER; note = uracil
  modified_base 291: mod_base = OTHER; note = uracil
  modified_base 293: mod_base = OTHER; note = uracil
tygttygtttygggagygtttygtyggtttygtgttgggagtygggyggyggyggygaggttgggggtygygggyggagaaggaggaggtygttgyggggtttttygttgttttttyggagtygtygtttagattyggagtttygtygtygtttggttttgtyggagtttttygggatttgttagttagatgtgataagattgtggygaggygagtgaaggagatttgatattaattagygygtagtttygagttaaatttttataaatgyggtgtagaaatatgttttttttatttaag

SEQ ID NO: 201 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 21: mod_base = OTHER; note = uracil
  modified_base 28: mod_base = OTHER; note = uracil
  modified_base 29: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 71: mod_base = OTHER; note = uracil
  modified_base 82: mod_base = OTHER; note = uracil
  modified_base 83: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 111: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 141: mod_base = OTHER; note = uracil
  modified_base 160: mod_base = OTHER; note = uracil
  modified_base 166: mod_base = OTHER; note = uracil
  modified_base 167: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 183: mod_base = OTHER; note = uracil
  modified_base 184: mod_base = OTHER; note = uracil
  modified_base 190: mod_base = OTHER; note = uracil
  modified_base 198: mod_base = OTHER; note = uracil
  modified_base 199: mod_base = OTHER; note = uracil
  modified_base 207: mod_base = OTHER; note = uracil
  modified_base 210: mod_base = OTHER; note = uracil
  modified_base 214: mod_base = OTHER; note = uracil
  modified_base 222: mod_base = OTHER; note = uracil
  modified_base 224: mod_base = OTHER; note = uracil
  modified_base 228: mod_base = OTHER; note = uracil
  modified_base 233: mod_base = OTHER; note = uracil
  modified_base 239: mod_base = OTHER; note = uracil
  modified_base 240: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 270: mod_base = OTHER; note = uracil
  modified_base 281: mod_base = OTHER; note = uracil
  modified_base 282: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
gtggtaggtttgtgtggagatttgaattttgtttttttttagttttttttattaaggatatttaggagagtaaggatatggttagaggagaggtggtgttttttttttgattgggttttgtttttagttttataggtgattyggaagattygggtggagtagttttttgatgttttyggtagtttgaagttgtggtgttagttttttaatatttttagtgatttagttttgatatgggttaaggattagygtttagtgggygaggtgggtaggaggtaagttaaygatattattgttatt

SEQ ID NO: 202 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 52: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 70: mod_base = OTHER; note = uracil
  modified_base 75: mod_base = OTHER; note = uracil
  modified_base 81: mod_base = OTHER; note = uracil
  modified_base 83: mod_base = OTHER; note = uracil
  modified_base 100: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 119: mod_base = OTHER; note = uracil
  modified_base 122: mod_base = OTHER; note = uracil
  modified_base 129: mod_base = OTHER; note = uracil
  modified_base 132: mod_base = OTHER; note = uracil
  modified_base 139: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 148: mod_base = OTHER; note = uracil
  modified_base 154: mod_base = OTHER; note = uracil
  modified_base 157: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 174: mod_base = OTHER; note = uracil
  modified_base 181: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 220: mod_base = OTHER; note = uracil
  modified_base 221: mod_base = OTHER; note = uracil
  modified_base 226: mod_base = OTHER; note = uracil
  modified_base 227: mod_base = OTHER; note = uracil
  modified_base 231: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 244: mod_base = OTHER; note = uracil
  modified_base 245: mod_base = OTHER; note = uracil
  modified_base 259: mod_base = OTHER; note = uracil
  modified_base 270: mod_base = OTHER; note = uracil
  modified_base 277: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 300: mod_base = OTHER; note = uracil
ggtggtagtggtgtygttggtttattttttgtttatttygtttattgggygttgatttttggtttatgttaagattgagttattaagaatgttgaaaaattggtattatagttttaggttatyggaggtattaggaaattgttttattygaatttttyggattatttgtggggttgagagtagggtttagttaagaggggaatattattttttttttggttatatttttgtttttttgggtgtttttggtggaaaaggttgggagaaaataggatttaagtttttatatagatttattat

SEQ ID NO: 203 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 13: mod_base = OTHER; note = uracil
  modified_base 26: mod_base = OTHER; note = uracil
  modified_base 39: mod_base = OTHER; note = uracil
  modified_base 44: mod_base = OTHER; note = uracil
  modified_base 49: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 70: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 79: mod_base = OTHER; note = uracil
  modified_base 97: mod_base = OTHER; note = uracil
  modified_base 133: mod_base = OTHER; note = uracil
  modified_base 146: mod_base = OTHER; note = uracil
  modified_base 155: mod_base = OTHER; note = uracil
  modified_base 172: mod_base = OTHER; note = uracil
  modified_base 177: mod_base = OTHER; note = uracil
  modified_base 178: mod_base = OTHER; note = uracil
  modified_base 188: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 207: mod_base = OTHER; note = uracil
  modified_base 209: mod_base = OTHER; note = uracil
  modified_base 213: mod_base = OTHER; note = uracil
  modified_base 243: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 256: mod_base = OTHER; note = uracil
  modified_base 264: mod_base = OTHER; note = uracil
  modified_base 281: mod_base = OTHER; note = uracil
tgtttattatatttygtgggtgaaatagatatttygagtatgattgagtttattaagagttttgyggygttttttttgtygggggtttagaaattttaaaggatgggggttgagggagggaggagttatgggtatgtgatgtggatagggygggtaggaggatggaagtaataggtttaaaatgtatttttggtggttyggtagagtttttgtatggggtgagaatggtaatttaggaagagtaagtttttttatttgtgaagtagaagaaaaaagtggatttaaggagaagttygggtg

SEQ ID NO: 204 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 32: mod_base = OTHER; note = uracil
  modified_base 35: mod_base = OTHER; note = uracil
  modified_base 38: mod_base = OTHER; note = uracil
  modified_base 41: mod_base = OTHER; note = uracil
  modified_base 43: mod_base = OTHER; note = uracil
  modified_base 55: mod_base = OTHER; note = uracil
  modified_base 59: mod_base = OTHER; note = uracil
  modified_base 61: mod_base = OTHER; note = uracil
  modified_base 64: mod_base = OTHER; note = uracil
  modified_base 65: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 95: mod_base = OTHER; note = uracil
  modified_base 97: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 117: mod_base = OTHER; note = uracil
  modified_base 126: mod_base = OTHER; note = uracil
  modified_base 127: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 234: mod_base = OTHER; note = uracil
  modified_base 237: mod_base = OTHER; note = uracil
  modified_base 242: mod_base = OTHER; note = uracil
  modified_base 244: mod_base = OTHER; note = uracil
  modified_base 253: mod_base = OTHER; note = uracil
  modified_base 255: mod_base = OTHER; note = uracil
  modified_base 259: mod_base = OTHER; note = uracil
  modified_base 263: mod_base = OTHER; note = uracil
  modified_base 273: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 299: mod_base = OTHER; note = uracil
tattygaatttttttttaagtttattttttttttttgttttatagatgggaagatttgttttttttaaattattatttttattttatgtaagagttttgtygggttattaaagatatattttggatttgttatttttatttttttgttygttttgtttatattatatgtttataattttttttttttttaatttttattttttgaaatttttaaattttyggtagaggaagygtygtagggtttttaataagtttagttatgttygaaatatttgttttatttaygaggtgtggtaggta

SEQ ID NO: 205 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 8: mod_base = OTHER; note = uracil
  modified_base 9: mod_base = OTHER; note = uracil
  modified_base 11: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 22: mod_base = OTHER; note = uracil
  modified_base 23: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 48: mod_base = OTHER; note = uracil
  modified_base 50: mod_base = OTHER; note = uracil
  modified_base 54: mod_base = OTHER; note = uracil
  modified_base 55: mod_base = OTHER; note = uracil
  modified_base 65: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 132: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 178: mod_base = OTHER; note = uracil
  modified_base 180: mod_base = OTHER; note = uracil
  modified_base 182: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 195: mod_base = OTHER; note = uracil
  modified_base 197: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 214: mod_base = OTHER; note = uracil
  modified_base 216: mod_base = OTHER; note = uracil
  modified_base 218: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 232: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 248: mod_base = OTHER; note = uracil
  modified_base 250: mod_base = OTHER; note = uracil
  modified_base 254: mod_base = OTHER; note = uracil
  modified_base 258: mod_base = OTHER; note = uracil
  modified_base 260: mod_base = OTHER; note = uracil
  modified_base 262: mod_base = OTHER; note = uracil
  modified_base 266: mod_base = OTHER; note = uracil
  modified_base 268: mod_base = OTHER; note = uracil
  modified_base 270: mod_base = OTHER; note = uracil
  modified_base 272: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 285: mod_base = OTHER; note = uracil
  modified_base 289: mod_base = OTHER; note = uracil
  modified_base 292: mod_base = OTHER; note = uracil
  modified_base 299: mod_base = OTHER; note = uracil
gagttaatttttttttttatttttggaggtgggggattygtttttattttaggtttgaagagggttgtgtgtgagttttttatttgtgtgtggggtgagttyggtttatgtatatagttatatatatattatatatttatattyggataygygttttaggtttttatattgtttttatatatatgygttttttatatatgtatgttttttttgtatataygttttttygtataygtatgttttttygtataygtatgtatataggtttattttgttgtttgtttttggttgttgtgtgtt

SEQ ID NO: 206 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 7: mod_base = OTHER; note = uracil
  modified_base 10: mod_base = OTHER; note = uracil
  modified_base 13: mod_base = OTHER; note = uracil
  modified_base 14: mod_base = OTHER; note = uracil
  modified_base 20: mod_base = OTHER; note = uracil
  modified_base 24: mod_base = OTHER; note = uracil
  modified_base 27: mod_base = OTHER; note = uracil
  modified_base 36: mod_base = OTHER; note = uracil
  modified_base 37: mod_base = OTHER; note = uracil
  modified_base 44: mod_base = OTHER; note = uracil
  modified_base 62: mod_base = OTHER; note = uracil
  modified_base 88: mod_base = OTHER; note = uracil
  modified_base 97: mod_base = OTHER; note = uracil
  modified_base 101: mod_base = OTHER; note = uracil
  modified_base 116: mod_base = OTHER; note = uracil
  modified_base 130: mod_base = OTHER; note = uracil
  modified_base 141: mod_base = OTHER; note = uracil
  modified_base 142: mod_base = OTHER; note = uracil
  modified_base 155: mod_base = OTHER; note = uracil
  modified_base 184: mod_base = OTHER; note = uracil
  modified_base 191: mod_base = OTHER; note = uracil
  modified_base 197: mod_base = OTHER; note = uracil
  modified_base 202: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 215: mod_base = OTHER; note = uracil
  modified_base 226: mod_base = OTHER; note = uracil
  modified_base 228: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 298: mod_base = OTHER; note = uracil
  modified_base 300: mod_base = OTHER; note = uracil
agtatatagtagttagggataggtagtagagtgagtttgtgtgtatgygtgtgygagggggtatgygtgtgygagggggygtgtgtgtaaaggggatatgtatgtgtgaggggygtatgtgtgtaagggtagtgtggggatttgaggygygtgttygggtgtgggtgtgtgatgtgtgtgtagttgtgtgtatgggtygggtttattttatatataagtggagaatttatatatagttttttttaggtttgagatgagggygggttttttatttttaggaatgaaaggagaggttggttt

SEQ ID NO: 207 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 49: mod_base = OTHER; note = uracil
  modified_base 60: mod_base = OTHER; note = uracil
  modified_base 61: mod_base = OTHER; note = uracil
  modified_base 69: mod_base = OTHER; note = uracil
  modified_base 70: mod_base = OTHER; note = uracil
  modified_base 98: mod_base = OTHER; note = uracil
  modified_base 101: mod_base = OTHER; note = uracil
  modified_base 107: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 125: mod_base = OTHER; note = uracil
  modified_base 145: mod_base = OTHER; note = uracil
  modified_base 154: mod_base = OTHER; note = uracil
  modified_base 157: mod_base = OTHER; note = uracil
  modified_base 163: mod_base = OTHER; note = uracil
  modified_base 169: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 194: mod_base = OTHER; note = uracil
  modified_base 198: mod_base = OTHER; note = uracil
  modified_base 204: mod_base = OTHER; note = uracil
  modified_base 207: mod_base = OTHER; note = uracil
  modified_base 210: mod_base = OTHER; note = uracil
  modified_base 215: mod_base = OTHER; note = uracil
  modified_base 219: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 245: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 299: mod_base = OTHER; note = uracil
tttaygggggtaggtatyggagggggtgtttatagaggatagaggaygtygagaagtgatttggggagttataggatgaggaagagagaagagatgatagtaggggttgtaggaggttattttttayggagggaggggtgayggtagaggygttygtaggagttggtatyggtggggttgtttttagggggggttgatagaggtagtaattgagtaggtaggggtggagygaggtgttagtttgtygtggaaaggagaygttagtagyggggggtttttttggggttttagttttgtttt

SEQ ID NO: 208 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 10: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 37: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 57: mod_base = OTHER; note = uracil
  modified_base 61: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 89: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 151: mod_base = OTHER; note = uracil
  modified_base 152: mod_base = OTHER; note = uracil
  modified_base 154: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 205: mod_base = OTHER; note = uracil
  modified_base 208: mod_base = OTHER; note = uracil
  modified_base 210: mod_base = OTHER; note = uracil
  modified_base 213: mod_base = OTHER; note = uracil
  modified_base 215: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 263: mod_base = OTHER; note = uracil
  modified_base 264: mod_base = OTHER; note = uracil
  modified_base 266: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
agagtaggattgggattttaggagggtttttygttgttggygttttttttttayggtaggttggtatttygttttatttttgtttgtttagttgttgtttttgttagttttttttgggggtagttttatyggtattagtttttgyggaygtttttgtygttattttttttttygtggagggtgattttttatagtttttgttgttatttttttttttttttttattttatggttttttaggttatttttyggygttttttattttttgtgggtatttttttyggtgtttgttttygtggg

SEQ ID NO: 209 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 8: mod_base = OTHER; note = uracil
  modified_base 14: mod_base = OTHER; note = uracil
  modified_base 15: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 101: mod_base = OTHER; note = uracil
  modified_base 106: mod_base = OTHER; note = uracil
  modified_base 107: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 146: mod_base = OTHER; note = uracil
  modified_base 155: mod_base = OTHER; note = uracil
  modified_base 167: mod_base = OTHER; note = uracil
  modified_base 168: mod_base = OTHER; note = uracil
  modified_base 173: mod_base = OTHER; note = uracil
  modified_base 183: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 210: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 232: mod_base = OTHER; note = uracil
  modified_base 236: mod_base = OTHER; note = uracil
  modified_base 240: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 254: mod_base = OTHER; note = uracil
  modified_base 260: mod_base = OTHER; note = uracil
  modified_base 269: mod_base = OTHER; note = uracil
  modified_base 276: mod_base = OTHER; note = uracil
  modified_base 278: mod_base = OTHER; note = uracil
  modified_base 280: mod_base = OTHER; note = uracil
  modified_base 287: mod_base = OTHER; note = uracil
  modified_base 290: mod_base = OTHER; note = uracil
  modified_base 292: mod_base = OTHER; note = uracil
  modified_base 298: mod_base = OTHER; note = uracil
tgatatttaggatttaaaagttagttttgtttattttagtttttggatttgtttatttgggtgtgtatttgtttyggggggtggaggtgttttttatagttygggttaggatagttttaggggagagtgaaggtttgtaggagggtaggygagataaggagggtgtttagggttagggagtgtyggatgaaattagttttgtttttgtgtaggttttaggttttygtttgataaataggtagggagttatagttagggataataaaaatttggtgtattttgaaagtagtatttggatag

SEQ ID NO: 210 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 11: mod_base = OTHER; note = uracil
  modified_base 14: mod_base = OTHER; note = uracil
  modified_base 18: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 48: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 70: mod_base = OTHER; note = uracil
  modified_base 80: mod_base = OTHER; note = uracil
  modified_base 81: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 93: mod_base = OTHER; note = uracil
  modified_base 99: mod_base = OTHER; note = uracil
  modified_base 104: mod_base = OTHER; note = uracil
  modified_base 111: mod_base = OTHER; note = uracil
  modified_base 114: mod_base = OTHER; note = uracil
  modified_base 118: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 173: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 229: mod_base = OTHER; note = uracil
  modified_base 235: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 249: mod_base = OTHER; note = uracil
  modified_base 254: mod_base = OTHER; note = uracil
  modified_base 255: mod_base = OTHER; note = uracil
  modified_base 261: mod_base = OTHER; note = uracil
  modified_base 271: mod_base = OTHER; note = uracil
  modified_base 276: mod_base = OTHER; note = uracil
  modified_base 280: mod_base = OTHER; note = uracil
  modified_base 289: mod_base = OTHER; note = uracil
  modified_base 290: mod_base = OTHER; note = uracil
  modified_base 298: mod_base = OTHER; note = uracil
  modified_base 300: mod_base = OTHER; note = uracil
tgtttaagtgttgtttttagagtgtattaagtttttattgtttttgattgtggttttttgtttgtttgttaggygggagtttggagtttgtatagggatagagttggttttattyggtattttttagttttggatattttttttgtttygtttgtttttttgtaggtttttatttttttttgaggttgttttggttyggattgtggggagtatttttatttttyggagtaggtgtatatttaggtaagtaggtttaggggttggggtgggtagggttagtttttggattttgagtgttat

SEQ ID NO: 211 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 25: mod_base = OTHER; note = uracil
  modified_base 27: mod_base = OTHER; note = uracil
  modified_base 40: mod_base = OTHER; note = uracil
  modified_base 42: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 63: mod_base = OTHER; note = uracil
  modified_base 73: mod_base = OTHER; note = uracil
  modified_base 75: mod_base = OTHER; note = uracil
  modified_base 85: mod_base = OTHER; note = uracil
  modified_base 96: mod_base = OTHER; note = uracil
  modified_base 102: mod_base = OTHER; note = uracil
  modified_base 104: mod_base = OTHER; note = uracil
  modified_base 114: mod_base = OTHER; note = uracil
  modified_base 118: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 138: mod_base = OTHER; note = uracil
  modified_base 144: mod_base = OTHER; note = uracil
  modified_base 148: mod_base = OTHER; note = uracil
  modified_base 153: mod_base = OTHER; note = uracil
  modified_base 161: mod_base = OTHER; note = uracil
  modified_base 164: mod_base = OTHER; note = uracil
  modified_base 165: mod_base = OTHER; note = uracil
  modified_base 168: mod_base = OTHER; note = uracil
  modified_base 170: mod_base = OTHER; note = uracil
  modified_base 176: mod_base = OTHER; note = uracil
  modified_base 178: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 206: mod_base = OTHER; note = uracil
  modified_base 212: mod_base = OTHER; note = uracil
  modified_base 216: mod_base = OTHER; note = uracil
  modified_base 224: mod_base = OTHER; note = uracil
  modified_base 232: mod_base = OTHER; note = uracil
  modified_base 237: mod_base = OTHER; note = uracil
  modified_base 238: mod_base = OTHER; note = uracil
  modified_base 244: mod_base = OTHER; note = uracil
  modified_base 247: mod_base = OTHER; note = uracil
  modified_base 252: mod_base = OTHER; note = uracil
  modified_base 257: mod_base = OTHER; note = uracil
  modified_base 265: mod_base = OTHER; note = uracil
  modified_base 267: mod_base = OTHER; note = uracil
  modified_base 271: mod_base = OTHER; note = uracil
  modified_base 272: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 291: mod_base = OTHER; note = uracil
taaataagtagttattttagaagttatttaygtaaaagatttattttttaaaaygttaggtatatggattattattgtgttatttaaygaygatataatggtatagaatgtattatattgagaagtgagtgtttttttygggatatattygttagtgagttatttagtattagaatattggagatataaataaatattattttttttaaaatagtttgaaatttaagtggttataatttagagtattatggtygggtatggtggtttatgtttgtaattttagtatgaggttgagatggg

SEQ ID NO: 212 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 5: mod_base = OTHER; note = uracil
  modified_base 7: mod_base = OTHER; note = uracil
  modified_base 10: mod_base = OTHER; note = uracil
  modified_base 11: mod_base = OTHER; note = uracil
  modified_base 13: mod_base = OTHER; note = uracil
  modified_base 17: mod_base = OTHER; note = uracil
  modified_base 26: mod_base = OTHER; note = uracil
  modified_base 30: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 44: mod_base = OTHER; note = uracil
  modified_base 45: mod_base = OTHER; note = uracil
  modified_base 49: mod_base = OTHER; note = uracil
  modified_base 50: mod_base = OTHER; note = uracil
  modified_base 57: mod_base = OTHER; note = uracil
  modified_base 59: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 82: mod_base = OTHER; note = uracil
  modified_base 86: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 127: mod_base = OTHER; note = uracil
  modified_base 133: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 158: mod_base = OTHER; note = uracil
  modified_base 159: mod_base = OTHER; note = uracil
  modified_base 169: mod_base = OTHER; note = uracil
  modified_base 171: mod_base = OTHER; note = uracil
  modified_base 173: mod_base = OTHER; note = uracil
  modified_base 175: mod_base = OTHER; note = uracil
  modified_base 178: mod_base = OTHER; note = uracil
  modified_base 180: mod_base = OTHER; note = uracil
  modified_base 190: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 221: mod_base = OTHER; note = uracil
  modified_base 223: mod_base = OTHER; note = uracil
  modified_base 233: mod_base = OTHER; note = uracil
  modified_base 234: mod_base = OTHER; note = uracil
  modified_base 240: mod_base = OTHER; note = uracil
  modified_base 241: mod_base = OTHER; note = uracil
  modified_base 262: mod_base = OTHER; note = uracil
  modified_base 277: mod_base = OTHER; note = uracil
  modified_base 280: mod_base = OTHER; note = uracil
  modified_base 289: mod_base = OTHER; note = uracil
  modified_base 292: mod_base = OTHER; note = uracil
ttattttagttttatgttggggttataggtatgagttattatgttyggttatgatgttttaggttatgattatttgaattttagattgttttagaagaggtggtatttatttatatttttagtgttttagtgttggatgatttattgaygagtatgtttyggagagggtatttattttttagtatgatatattttgtgttattgtatygtygttgaataatatagtgataatttatgtgtttggygttttggggaatgagttttttaygtaagtgatttttgaggtaattatttatttga

SEQ ID NO: 213 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 8: mod_base = OTHER; note = uracil
  modified_base 15: mod_base = OTHER; note = uracil
  modified_base 17: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 32: mod_base = OTHER; note = uracil
  modified_base 43: mod_base = OTHER; note = uracil
  modified_base 47: mod_base = OTHER; note = uracil
  modified_base 49: mod_base = OTHER; note = uracil
  modified_base 53: mod_base = OTHER; note = uracil
  modified_base 57: mod_base = OTHER; note = uracil
  modified_base 65: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 78: mod_base = OTHER; note = uracil
  modified_base 88: mod_base = OTHER; note = uracil
  modified_base 90: mod_base = OTHER; note = uracil
  modified_base 93: mod_base = OTHER; note = uracil
  modified_base 99: mod_base = OTHER; note = uracil
  modified_base 105: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 122: mod_base = OTHER; note = uracil
  modified_base 130: mod_base = OTHER; note = uracil
  modified_base 132: mod_base = OTHER; note = uracil
  modified_base 135: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 189: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 209: mod_base = OTHER; note = uracil
  modified_base 214: mod_base = OTHER; note = uracil
  modified_base 215: mod_base = OTHER; note = uracil
  modified_base 221: mod_base = OTHER; note = uracil
  modified_base 235: mod_base = OTHER; note = uracil
  modified_base 240: mod_base = OTHER; note = uracil
  modified_base 241: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 268: mod_base = OTHER; note = uracil
  modified_base 275: mod_base = OTHER; note = uracil
  modified_base 276: mod_base = OTHER; note = uracil
  modified_base 284: mod_base = OTHER; note = uracil
  modified_base 298: mod_base = OTHER; note = uracil
  modified_base 299: mod_base = OTHER; note = uracil
gtttttatatttgatttyggataaatttttttaaatattttatagattttggttttttygttaataagtagtttatatatatagtgttttagtagtgatagatgttggtttatttygaggttaggatgatttagtagggattgagtttgygggygttatgttttaaggttyggaataggaggttggtgtttattttttatatagtgggtaaattttagggtaggggagggggggtaatgttagagaatggtttttatttggggyggtttgayggttagagatgtagagaaagagaygttt

SEQ ID NO: 214 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 9: mod_base = OTHER; note = uracil
  modified_base 13: mod_base = OTHER; note = uracil
  modified_base 15: mod_base = OTHER; note = uracil
  modified_base 18: mod_base = OTHER; note = uracil
  modified_base 21: mod_base = OTHER; note = uracil
  modified_base 23: mod_base = OTHER; note = uracil
  modified_base 27: mod_base = OTHER; note = uracil
  modified_base 31: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 58: mod_base = OTHER; note = uracil
  modified_base 62: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 141: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 156: mod_base = OTHER; note = uracil
  modified_base 158: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 200: mod_base = OTHER; note = uracil
  modified_base 204: mod_base = OTHER; note = uracil
  modified_base 206: mod_base = OTHER; note = uracil
  modified_base 209: mod_base = OTHER; note = uracil
  modified_base 215: mod_base = OTHER; note = uracil
  modified_base 217: mod_base = OTHER; note = uracil
  modified_base 230: mod_base = OTHER; note = uracil
  modified_base 233: mod_base = OTHER; note = uracil
  modified_base 249: mod_base = OTHER; note = uracil
  modified_base 250: mod_base = OTHER; note = uracil
  modified_base 256: mod_base = OTHER; note = uracil
  modified_base 281: mod_base = OTHER; note = uracil
  modified_base 288: mod_base = OTHER; note = uracil
  modified_base 300: mod_base = OTHER; note = uracil
aggygtttttttttttgtatttttggtygttagatygttttaggtggggattattttttggtattgtttttttttttttgttttaggatttgtttattatgtgaggaatgagtattaattttttatttygggttttggagtatgaygttygtaaatttaatttttgttgagttattttgatttyggggtgggttagtatttgttattgttgagatattatatgtgtgagttgtttgttaaygagaaagttagagtttgtaaaatatttgaagaggtttattyggagttaaatgtgaggat

SEQ ID NO: 215 - DNA, 299 bp, synthetic construct
  misc_feature 1..299: note = Synthetic polynucleotide
  source 1..299: mol_type = other DNA
  modified_base 6: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 41: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 69: mod_base = OTHER; note = uracil
  modified_base 80: mod_base = OTHER; note = uracil
  modified_base 82: mod_base = OTHER; note = uracil
  modified_base 90: mod_base = OTHER; note = uracil
  modified_base 98: mod_base = OTHER; note = uracil
  modified_base 99: mod_base = OTHER; note = uracil
  modified_base 102: mod_base = OTHER; note = uracil
  modified_base 105: mod_base = OTHER; note = uracil
  modified_base 111: mod_base = OTHER; note = uracil
  modified_base 115: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 124: mod_base = OTHER; note = uracil
  modified_base 126: mod_base = OTHER; note = uracil
  modified_base 134: mod_base = OTHER; note = uracil
  modified_base 142: mod_base = OTHER; note = uracil
  modified_base 160: mod_base = OTHER; note = uracil
  modified_base 166: mod_base = OTHER; note = uracil
  modified_base 169: mod_base = OTHER; note = uracil
  modified_base 170: mod_base = OTHER; note = uracil
  modified_base 180: mod_base = OTHER; note = uracil
  modified_base 189: mod_base = OTHER; note = uracil
  modified_base 192: mod_base = OTHER; note = uracil
  modified_base 203: mod_base = OTHER; note = uracil
  modified_base 205: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 215: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 236: mod_base = OTHER; note = uracil
  modified_base 237: mod_base = OTHER; note = uracil
  modified_base 241: mod_base = OTHER; note = uracil
  modified_base 242: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 264: mod_base = OTHER; note = uracil
  modified_base 271: mod_base = OTHER; note = uracil
  modified_base 290: mod_base = OTHER; note = uracil
  modified_base 298: mod_base = OTHER; note = uracil
gaaagtagttttttttttgttttgtaaggtgattttygattygggaatttttatttttgaaggaygttttggaaaagtgtatagattaattgagatttttgtttttggattaagtatttttgatattatygtttygattttttaaaaaagagattgtggtaaaatttatttygtgagattagaaaatgtagtagggatgaattatyggtttttttagattttattagtttttaggttatttttaagagttttattttttygttttgttggtagtgggggaggtayggggtyggatggta

SEQ ID NO: 216 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 7: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 18: mod_base = OTHER; note = uracil
  modified_base 19: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 52: mod_base = OTHER; note = uracil
  modified_base 54: mod_base = OTHER; note = uracil
  modified_base 65: mod_base = OTHER; note = uracil
  modified_base 66: mod_base = OTHER; note = uracil
  modified_base 73: mod_base = OTHER; note = uracil
  modified_base 83: mod_base = OTHER; note = uracil
  modified_base 92: mod_base = OTHER; note = uracil
  modified_base 101: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 112: mod_base = OTHER; note = uracil
  modified_base 118: mod_base = OTHER; note = uracil
  modified_base 123: mod_base = OTHER; note = uracil
  modified_base 125: mod_base = OTHER; note = uracil
  modified_base 127: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 149: mod_base = OTHER; note = uracil
  modified_base 151: mod_base = OTHER; note = uracil
  modified_base 179: mod_base = OTHER; note = uracil
  modified_base 187: mod_base = OTHER; note = uracil
  modified_base 193: mod_base = OTHER; note = uracil
  modified_base 194: mod_base = OTHER; note = uracil
  modified_base 200: mod_base = OTHER; note = uracil
  modified_base 207: mod_base = OTHER; note = uracil
  modified_base 209: mod_base = OTHER; note = uracil
  modified_base 217: mod_base = OTHER; note = uracil
  modified_base 222: mod_base = OTHER; note = uracil
  modified_base 224: mod_base = OTHER; note = uracil
  modified_base 229: mod_base = OTHER; note = uracil
  modified_base 230: mod_base = OTHER; note = uracil
  modified_base 238: mod_base = OTHER; note = uracil
  modified_base 239: mod_base = OTHER; note = uracil
  modified_base 242: mod_base = OTHER; note = uracil
  modified_base 256: mod_base = OTHER; note = uracil
  modified_base 257: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 277: mod_base = OTHER; note = uracil
  modified_base 282: mod_base = OTHER; note = uracil
  modified_base 293: mod_base = OTHER; note = uracil
  modified_base 296: mod_base = OTHER; note = uracil
  modified_base 300: mod_base = OTHER; note = uracil
tgttattyggtttygtattttttttattgttaatagaayggaggagtgaggtttttaggaatggtttggaggttggtgaggtttgagagggtyggtgatttatttttgttgtattttttgattttatygaggtagattttgttataattttttttttagaaaatyggaaygatagtgttaggagtgtttgatttagaagtaggaattttagttaatttgtgtatttttttagaaygttttttagaagtgggaattttyggatyggggattattttatagggtagggagagggttgttttt

SEQ ID NO: 217 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 42: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 85: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 97: mod_base = OTHER; note = uracil
  modified_base 100: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 119: mod_base = OTHER; note = uracil
  modified_base 120: mod_base = OTHER; note = uracil
  modified_base 128: mod_base = OTHER; note = uracil
  modified_base 131: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 143: mod_base = OTHER; note = uracil
  modified_base 150: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 172: mod_base = OTHER; note = uracil
  modified_base 181: mod_base = OTHER; note = uracil
  modified_base 185: mod_base = OTHER; note = uracil
  modified_base 189: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 199: mod_base = OTHER; note = uracil
  modified_base 206: mod_base = OTHER; note = uracil
  modified_base 230: mod_base = OTHER; note = uracil
  modified_base 231: mod_base = OTHER; note = uracil
  modified_base 236: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 262: mod_base = OTHER; note = uracil
  modified_base 265: mod_base = OTHER; note = uracil
  modified_base 267: mod_base = OTHER; note = uracil
  modified_base 269: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 297: mod_base = OTHER; note = uracil
aagaaaagagaaagtttatttaggtaagggtagtttggtgattattattttggggagattttttatttatattgttattttaggtttattygagggttgtagtttttttyggatggatttagggyggttattggttttagagttgggggttgagtgggttygtgtygagggttgtggygtttgataagtyggtttttattgtgagtagggaagggyggatgggygggggttayggttgttttggttttttattttgttgtgtttttttttatttttttgttttgttttttaatatttagt

SEQ ID NO: 218 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 17: mod_base = OTHER; note = uracil
  modified_base 22: mod_base = OTHER; note = uracil
  modified_base 40: mod_base = OTHER; note = uracil
  modified_base 42: mod_base = OTHER; note = uracil
  modified_base 45: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 66: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 96: mod_base = OTHER; note = uracil
  modified_base 98: mod_base = OTHER; note = uracil
  modified_base 100: mod_base = OTHER; note = uracil
  modified_base 109: mod_base = OTHER; note = uracil
  modified_base 113: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 159: mod_base = OTHER; note = uracil
  modified_base 161: mod_base = OTHER; note = uracil
  modified_base 167: mod_base = OTHER; note = uracil
  modified_base 168: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 199: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 217: mod_base = OTHER; note = uracil
  modified_base 218: mod_base = OTHER; note = uracil
  modified_base 227: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 261: mod_base = OTHER; note = uracil
  modified_base 263: mod_base = OTHER; note = uracil
  modified_base 264: mod_base = OTHER; note = uracil
  modified_base 268: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 277: mod_base = OTHER; note = uracil
  modified_base 278: mod_base = OTHER; note = uracil
  modified_base 287: mod_base = OTHER; note = uracil
  modified_base 291: mod_base = OTHER; note = uracil
  modified_base 293: mod_base = OTHER; note = uracil
  modified_base 298: mod_base = OTHER; note = uracil
attgggtgttaggaggtagggtaggggagtagagagaagtatagtagggtggggagttagggtagtygtggttttygtttattygtttttttttgtttatagtgggagtyggtttgttagaygttatagttttyggtaygggtttatttagtttttagttttgggattagtagtygttttggatttattyggaggaagttgtagttttygggtgagtttggagtggtagtgtgggtggggagtttttttagggtaatagttattaggttgtttttatttggatgggtttttttttttttt

SEQ ID NO: 219 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 12: mod_base = OTHER; note = uracil
  modified_base 15: mod_base = OTHER; note = uracil
  modified_base 19: mod_base = OTHER; note = uracil
  modified_base 21: mod_base = OTHER; note = uracil
  modified_base 49: mod_base = OTHER; note = uracil
  modified_base 53: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 71: mod_base = OTHER; note = uracil
  modified_base 74: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 100: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 150: mod_base = OTHER; note = uracil
  modified_base 152: mod_base = OTHER; note = uracil
  modified_base 155: mod_base = OTHER; note = uracil
  modified_base 158: mod_base = OTHER; note = uracil
  modified_base 160: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 180: mod_base = OTHER; note = uracil
  modified_base 187: mod_base = OTHER; note = uracil
  modified_base 190: mod_base = OTHER; note = uracil
  modified_base 196: mod_base = OTHER; note = uracil
  modified_base 213: mod_base = OTHER; note = uracil
  modified_base 224: mod_base = OTHER; note = uracil
  modified_base 227: mod_base = OTHER; note = uracil
  modified_base 229: mod_base = OTHER; note = uracil
  modified_base 234: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 246: mod_base = OTHER; note = uracil
  modified_base 248: mod_base = OTHER; note = uracil
  modified_base 253: mod_base = OTHER; note = uracil
  modified_base 255: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 276: mod_base = OTHER; note = uracil
  modified_base 278: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 295: mod_base = OTHER; note = uracil
  modified_base 297: mod_base = OTHER; note = uracil
  modified_base 300: mod_base = OTHER; note = uracil
ttgaggtagggttgtaggtttaggaggaggagatgggtggagagagaataagtttatttygggagggtgattataggagaaatgggttttttaagtatgttgattttygttttattgttgtttgttttttygtttattttyggttttggtttatttgtttttgtaagtagggttttgggttgggtgttgtaggygtatgaggaaagtgggagtygggayggggtagtttagggtaygttttttaatattgygtttygaggattttagyggttttatttaggggtgttattgaggtatagt

SEQ ID NO: 220 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 31: mod_base = OTHER; note = uracil
  modified_base 34: mod_base = OTHER; note = uracil
  modified_base 41: mod_base = OTHER; note = uracil
  modified_base 42: mod_base = OTHER; note = uracil
  modified_base 51: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 99: mod_base = OTHER; note = uracil
  modified_base 100: mod_base = OTHER; note = uracil
  modified_base 102: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 138: mod_base = OTHER; note = uracil
  modified_base 144: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 177: mod_base = OTHER; note = uracil
  modified_base 181: mod_base = OTHER; note = uracil
  modified_base 184: mod_base = OTHER; note = uracil
  modified_base 199: mod_base = OTHER; note = uracil
  modified_base 202: mod_base = OTHER; note = uracil
  modified_base 206: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 249: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 296: mod_base = OTHER; note = uracil
  modified_base 298: mod_base = OTHER; note = uracil
gttgtgttttagtggtatttttgagtaaaatygttgaggttttyggagygtagtgttggagggygtgttttgagttgtttygtttyggtttttattttttttatgygtttgtagtatttagtttaggattttgtttataagagtagatgagttagagtyggaggtgggyggaagagtaggtagtagtgaggyggaaattagtatatttgaggggtttattttttttgtagttattttttyggggtgagtttgttttttttttatttattttttttttttgagtttgtagttttgttttag

SEQ ID NO: 221 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 8: mod_base = OTHER; note = uracil
  modified_base 16: mod_base = OTHER; note = uracil
  modified_base 28: mod_base = OTHER; note = uracil
  modified_base 33: mod_base = OTHER; note = uracil
  modified_base 35: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 60: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 81: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 92: mod_base = OTHER; note = uracil
  modified_base 93: mod_base = OTHER; note = uracil
  modified_base 102: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 153: mod_base = OTHER; note = uracil
  modified_base 154: mod_base = OTHER; note = uracil
  modified_base 163: mod_base = OTHER; note = uracil
  modified_base 167: mod_base = OTHER; note = uracil
  modified_base 172: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 196: mod_base = OTHER; note = uracil
  modified_base 198: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 219: mod_base = OTHER; note = uracil
  modified_base 232: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 290: mod_base = OTHER; note = uracil
  modified_base 294: mod_base = OTHER; note = uracil
  modified_base 297: mod_base = OTHER; note = uracil
gtttaggttggagtgtagtggygtgattttggtttattgtaatttttgtttttygggtttaagygatttttttgttttagttttttagatatttgggattataggtgtgtgatattatatttagttaatttttgtatttttagtagagayggttatgttagttaggttggttttgaatttttgattttagtgatttatyggttttagtttttaaagtgttggtattatagttatgagttattgtattyggtttttgtttttgtttttttagtggtattttattgttttgtttttaatatt

SEQ ID NO: 222 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 17: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 39: mod_base = OTHER; note = uracil
  modified_base 45: mod_base = OTHER; note = uracil
  modified_base 51: mod_base = OTHER; note = uracil
  modified_base 58: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 85: mod_base = OTHER; note = uracil
  modified_base 94: mod_base = OTHER; note = uracil
  modified_base 100: mod_base = OTHER; note = uracil
  modified_base 109: mod_base = OTHER; note = uracil
  modified_base 111: mod_base = OTHER; note = uracil
  modified_base 118: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 140: mod_base = OTHER; note = uracil
  modified_base 144: mod_base = OTHER; note = uracil
  modified_base 149: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 167: mod_base = OTHER; note = uracil
  modified_base 177: mod_base = OTHER; note = uracil
  modified_base 190: mod_base = OTHER; note = uracil
  modified_base 192: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 213: mod_base = OTHER; note = uracil
  modified_base 221: mod_base = OTHER; note = uracil
  modified_base 227: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 253: mod_base = OTHER; note = uracil
  modified_base 262: mod_base = OTHER; note = uracil
  modified_base 269: mod_base = OTHER; note = uracil
  modified_base 270: mod_base = OTHER; note = uracil
  modified_base 276: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 295: mod_base = OTHER; note = uracil
  modified_base 300: mod_base = OTHER; note = uracil
aatgttgaaagtaaggtagtgggatgttattaaggaagtaaaagtagaggtygggtgtagtggtttatgattataatattagtattttgggggttgaggtyggtgaattattgaggttaggagtttaagattagtttgattaatatggtygtttttattaaaaatataaaaattagttgggtatggtgttatatatttgtaattttaggtatttgggaggttgaggtaggagaatygtttgaattygggaggtagaggttgtagtgagttaagattaygttattgtattttagtttgggt

SEQ ID NO: 223 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 7: mod_base = OTHER; note = uracil
  modified_base 23: mod_base = OTHER; note = uracil
  modified_base 28: mod_base = OTHER; note = uracil
  modified_base 36: mod_base = OTHER; note = uracil
  modified_base 43: mod_base = OTHER; note = uracil
  modified_base 48: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 96: mod_base = OTHER; note = uracil
  modified_base 97: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 129: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 143: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 158: mod_base = OTHER; note = uracil
  modified_base 160: mod_base = OTHER; note = uracil
  modified_base 171: mod_base = OTHER; note = uracil
  modified_base 172: mod_base = OTHER; note = uracil
  modified_base 181: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 202: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 213: mod_base = OTHER; note = uracil
  modified_base 220: mod_base = OTHER; note = uracil
  modified_base 226: mod_base = OTHER; note = uracil
  modified_base 228: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 251: mod_base = OTHER; note = uracil
  modified_base 265: mod_base = OTHER; note = uracil
  modified_base 270: mod_base = OTHER; note = uracil
  modified_base 277: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gttattttataaaaatgaagagtagagttygagtgtttataataygttatttttatttaagatagagaagaaaaaygaaagagagtttgagtatttttttgattttttttattttyggaaggtatatttagagtttttaagattgttttygtttatttatatgtttatggttyggtgagatygtattttttttttttatatttgttttttttttggatgtagggatatagaattttttaagtgggaagagttttggagtggaggttgtttaaagttttgtggtgattaattattatttat

SEQ ID NO: 224 - DNA, 300 bp, synthetic construct
  misc_feature 1..300: note = Synthetic polynucleotide
  source 1..300: mol_type = other DNA
  modified_base 16: mod_base = OTHER; note = uracil
  modified_base 18: mod_base = OTHER; note = uracil
  modified_base 19: mod_base = OTHER; note = uracil
  modified_base 21: mod_base = OTHER; note = uracil
  modified_base 26: mod_base = OTHER; note = uracil
  modified_base 33: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 70: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 96: mod_base = OTHER; note = uracil
  modified_base 121: mod_base = OTHER; note = uracil
  modified_base 123: mod_base = OTHER; note = uracil
  modified_base 125: mod_base = OTHER; note = uracil
  modified_base 130: mod_base = OTHER; note = uracil
  modified_base 131: mod_base = OTHER; note = uracil
  modified_base 137: mod_base = OTHER; note = uracil
  modified_base 155: mod_base = OTHER; note = uracil
  modified_base 159: mod_base = OTHER; note = uracil
  modified_base 167: mod_base = OTHER; note = uracil
  modified_base 169: mod_base = OTHER; note = uracil
  modified_base 178: mod_base = OTHER; note = uracil
  modified_base 179: mod_base = OTHER; note = uracil
  modified_base 182: mod_base = OTHER; note = uracil
  modified_base 199: mod_base = OTHER; note = uracil
  modified_base 209: mod_base = OTHER; note = uracil
  modified_base 211: mod_base = OTHER; note = uracil
  modified_base 215: mod_base = OTHER; note = uracil
  modified_base 217: mod_base = OTHER; note = uracil
  modified_base 219: mod_base = OTHER; note = uracil
  modified_base 230: mod_base = OTHER; note = uracil
  modified_base 233: mod_base = OTHER; note = uracil
  modified_base 235: mod_base = OTHER; note = uracil
  modified_base 239: mod_base = OTHER; note = uracil
  modified_base 265: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 280: mod_base = OTHER; note = uracil
  modified_base 283: mod_base = OTHER; note = uracil
  modified_base 299: mod_base = OTHER; note = uracil
taggtaataattaattattatagaattttgaatagtttttattttaaagttttttttatttaggggattttgtgtttttgtatttagaaaagggatagatatagaaagggaggatgyggttttatygggttataaatatgtgagtgggyggaggtagttttggagattttgaatatatttttygggggtggagggagttaaaggaatgtttaggttttttttygttttttttttttgttttgggtaaaaatgaygtgttataagtattygagttttgttttttatttttatagagtggtt

SEQ ID NO: 225 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 18: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 36: mod_base = OTHER; note = uracil
  modified_base 40: mod_base = OTHER; note = uracil
  modified_base 42: mod_base = OTHER; note = uracil
  modified_base 54: mod_base = OTHER; note = uracil
  modified_base 62: mod_base = OTHER; note = uracil
  modified_base 63: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 83: mod_base = OTHER; note = uracil
  modified_base 87: mod_base = OTHER; note = uracil
  modified_base 92: mod_base = OTHER; note = uracil
  modified_base 96: mod_base = OTHER; note = uracil
  modified_base 107: mod_base = OTHER; note = uracil
  modified_base 125: mod_base = OTHER; note = uracil
  modified_base 142: mod_base = OTHER; note = uracil
  modified_base 144: mod_base = OTHER; note = uracil
  modified_base 157: mod_base = OTHER; note = uracil
  modified_base 166: mod_base = OTHER; note = uracil
  modified_base 177: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 215: mod_base = OTHER; note = uracil
  modified_base 217: mod_base = OTHER; note = uracil
  modified_base 222: mod_base = OTHER; note = uracil
  modified_base 226: mod_base = OTHER; note = uracil
  modified_base 227: mod_base = OTHER; note = uracil
  modified_base 231: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 277: mod_base = OTHER; note = uracil
  modified_base 283: mod_base = OTHER; note = uracil
  modified_base 288: mod_base = OTHER; note = uracil
  modified_base 290: mod_base = OTHER; note = uracil
  modified_base 296: mod_base = OTHER; note = uracil
attaaaatagtaaattttaggtttaaagtaggttttagtttttattaagataataaaaggttttaaatgttaggtttgggygtaaattgtgtagataagygggtggtyggagaaggaggggggttaaggaagagagggaaatttaattgayggttattttttttttagagttattttyggtgggtttgtttttattttttaataaattttgttgttttgagtattttaggtataaaaagtgaggttttggagggtttttgagattagygttttgtatagtgatatggtatagtgatatgg

SEQ ID NO: 226 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 7: mod_base = OTHER; note = uracil
  modified_base 9: mod_base = OTHER; note = uracil
  modified_base 14: mod_base = OTHER; note = uracil
  modified_base 15: mod_base = OTHER; note = uracil
  modified_base 20: mod_base = OTHER; note = uracil
  modified_base 22: mod_base = OTHER; note = uracil
  modified_base 27: mod_base = OTHER; note = uracil
  modified_base 34: mod_base = OTHER; note = uracil
  modified_base 39: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 51: mod_base = OTHER; note = uracil
  modified_base 52: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 71: mod_base = OTHER; note = uracil
  modified_base 72: mod_base = OTHER; note = uracil
  modified_base 80: mod_base = OTHER; note = uracil
  modified_base 82: mod_base = OTHER; note = uracil
  modified_base 87: mod_base = OTHER; note = uracil
  modified_base 90: mod_base = OTHER; note = uracil
  modified_base 113: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 131: mod_base = OTHER; note = uracil
  modified_base 133: mod_base = OTHER; note = uracil
  modified_base 148: mod_base = OTHER; note = uracil
  modified_base 152: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 207: mod_base = OTHER; note = uracil
  modified_base 210: mod_base = OTHER; note = uracil
  modified_base 212: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 227: mod_base = OTHER; note = uracil
  modified_base 228: mod_base = OTHER; note = uracil
  modified_base 232: mod_base = OTHER; note = uracil
  modified_base 241: mod_base = OTHER; note = uracil
  modified_base 242: mod_base = OTHER; note = uracil
  modified_base 252: mod_base = OTHER; note = uracil
  modified_base 263: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 280: mod_base = OTHER; note = uracil
  modified_base 281: mod_base = OTHER; note = uracil
  modified_base 291: mod_base = OTHER; note = uracil
ttatgttattgtgttatgttattgtgtaggaygttggttttaggggttttttagggttttattttttatgtttggaatgtttagagtaataaaatttgttgaggggtgggggtagatttatyggaaataattttgaaaaaaaagtaatygttaattgagttttttttttttttttgattttttttttttttyggttattygtttgtttgtatagtttgygtttaggtttggtatttaggattttttgttattttaatagagattgaaatttattttgggtttggagtttgttgttttaat

SEQ ID NO: 227 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 14: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 44: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 65: mod_base = OTHER; note = uracil
  modified_base 68: mod_base = OTHER; note = uracil
  modified_base 70: mod_base = OTHER; note = uracil
  modified_base 72: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 110: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 161: mod_base = OTHER; note = uracil
  modified_base 164: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 185: mod_base = OTHER; note = uracil
  modified_base 190: mod_base = OTHER; note = uracil
  modified_base 193: mod_base = OTHER; note = uracil
  modified_base 196: mod_base = OTHER; note = uracil
  modified_base 198: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 259: mod_base = OTHER; note = uracil
  modified_base 263: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 298: mod_base = OTHER; note = uracil
ggttttgagagtgttggaattaatyggayggggttagttttattatgggatttggtygatgagttatttttttgaaggygtttttttttttgtgaagtggggaaggtaattgttattttatagggygattgtgggtattygggagattygttgagggatgttgtagtgtagaagttttttaaatttaygttgtttttttttttttttagttttttttygttgttgtttttyggtttatgttttgtggttgatttattatyggttttttayggtttttattttgggygggttggatggttg

SEQ ID NO: 228 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 11: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 28: mod_base = OTHER; note = uracil
  modified_base 38: mod_base = OTHER; note = uracil
  modified_base 50: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 61: mod_base = OTHER; note = uracil
  modified_base 67: mod_base = OTHER; note = uracil
  modified_base 75: mod_base = OTHER; note = uracil
  modified_base 78: mod_base = OTHER; note = uracil
  modified_base 91: mod_base = OTHER; note = uracil
  modified_base 108: mod_base = OTHER; note = uracil
  modified_base 126: mod_base = OTHER; note = uracil
  modified_base 129: mod_base = OTHER; note = uracil
  modified_base 132: mod_base = OTHER; note = uracil
  modified_base 134: mod_base = OTHER; note = uracil
  modified_base 137: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 188: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 206: mod_base = OTHER; note = uracil
  modified_base 208: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 237: mod_base = OTHER; note = uracil
  modified_base 239: mod_base = OTHER; note = uracil
  modified_base 245: mod_base = OTHER; note = uracil
  modified_base 246: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 263: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 291: mod_base = OTHER; note = uracil
  modified_base 293: mod_base = OTHER; note = uracil
  modified_base 298: mod_base = OTHER; note = uracil
  modified_base 299: mod_base = OTHER; note = uracil
  modified_base 300: mod_base = OTHER; note = uracil
agttatttaattygtttaaggtgaaggtygtggagagtyggtgatggattagttatagggtatgaatyggagggtagtagygggagaggattgaggaggaagagaagtagygtagatttgggaagtttttatattgtagtattttttagygggtttttygggtgtttataatygttttgtgggatgatagttattttttttattttatagaagggaagaygtttttagagagatgatttatyggttaggttttatggtggggttgatttygttyggttggttttagtatttttagagttt

SEQ ID NO: 229 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 37: mod_base = OTHER; note = uracil
  modified_base 42: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 52: mod_base = OTHER; note = uracil
  modified_base 53: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 67: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 102: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 125: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 181: mod_base = OTHER; note = uracil
  modified_base 186: mod_base = OTHER; note = uracil
  modified_base 193: mod_base = OTHER; note = uracil
  modified_base 221: mod_base = OTHER; note = uracil
  modified_base 225: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 239: mod_base = OTHER; note = uracil
  modified_base 244: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 262: mod_base = OTHER; note = uracil
  modified_base 263: mod_base = OTHER; note = uracil
  modified_base 271: mod_base = OTHER; note = uracil
  modified_base 275: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 291: mod_base = OTHER; note = uracil
  modified_base 292: mod_base = OTHER; note = uracil
  modified_base 297: mod_base = OTHER; note = uracil
gtygtygtttttttagttttgtttaattyggtatttttgygtttgttttagttattygtaggagygtaggtygtttttygttttttygttttttgygtttataggatttygggtttygtttagttygtaggtttygtaggttttttygggygtgtttttttggttttgygattttygggatagygttgagaataygyggaaggtggggagaygygyggygttggtygggtttttggygtygttttygyggtgtagtttgtgtttgggagttyggtygttttattttagaattagagtaaa

SEQ ID NO: 230 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 7: mod_base = OTHER; note = uracil
  modified_base 13: mod_base = OTHER; note = uracil
  modified_base 27: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 42: mod_base = OTHER; note = uracil
  modified_base 46: mod_base = OTHER; note = uracil
  modified_base 49: mod_base = OTHER; note = uracil
  modified_base 51: mod_base = OTHER; note = uracil
  modified_base 65: mod_base = OTHER; note = uracil
  modified_base 66: mod_base = OTHER; note = uracil
  modified_base 72: mod_base = OTHER; note = uracil
  modified_base 73: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 91: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 99: mod_base = OTHER; note = uracil
  modified_base 102: mod_base = OTHER; note = uracil
  modified_base 111: mod_base = OTHER; note = uracil
  modified_base 113: mod_base = OTHER; note = uracil
  modified_base 118: mod_base = OTHER; note = uracil
  modified_base 122: mod_base = OTHER; note = uracil
  modified_base 123: mod_base = OTHER; note = uracil
  modified_base 133: mod_base = OTHER; note = uracil
  modified_base 138: mod_base = OTHER; note = uracil
  modified_base 139: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 171: mod_base = OTHER; note = uracil
  modified_base 178: mod_base = OTHER; note = uracil
  modified_base 188: mod_base = OTHER; note = uracil
  modified_base 189: mod_base = OTHER; note = uracil
  modified_base 196: mod_base = OTHER; note = uracil
  modified_base 197: mod_base = OTHER; note = uracil
  modified_base 206: mod_base = OTHER; note = uracil
  modified_base 231: mod_base = OTHER; note = uracil
  modified_base 232: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 250: mod_base = OTHER; note = uracil
  modified_base 256: mod_base = OTHER; note = uracil
  modified_base 262: mod_base = OTHER; note = uracil
  modified_base 270: mod_base = OTHER; note = uracil
  modified_base 280: mod_base = OTHER; note = uracil
  modified_base 285: mod_base = OTHER; note = uracil
  modified_base 300: mod_base = OTHER; note = uracil
tttgttttggttttgaggtgggayggtyggatttttaggtataggttgtatygygagaayggygttagggattyggttagygtygygygtttttttatttttygygtgtttttagygttgtttygggggtygtagggttaggaagataygttyggggggatttgygggatttgyggattgggyggggttyggggttttgtgggygtagaggaygggaggaygaagggyggtttgygtttttgygggtggttgaggtaagygtagaaatatygggttgggtaagattggaaaagyggyggt

SEQ ID NO: 231 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 8: mod_base = OTHER; note = uracil
  modified_base 12: mod_base = OTHER; note = uracil
  modified_base 14: mod_base = OTHER; note = uracil
  modified_base 23: mod_base = OTHER; note = uracil
  modified_base 26: mod_base = OTHER; note = uracil
  modified_base 31: mod_base = OTHER; note = uracil
  modified_base 32: mod_base = OTHER; note = uracil
  modified_base 35: mod_base = OTHER; note = uracil
  modified_base 38: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 54: mod_base = OTHER; note = uracil
  modified_base 56: mod_base = OTHER; note = uracil
  modified_base 60: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 90: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 105: mod_base = OTHER; note = uracil
  modified_base 112: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 146: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 169: mod_base = OTHER; note = uracil
  modified_base 170: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 198: mod_base = OTHER; note = uracil
  modified_base 204: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 219: mod_base = OTHER; note = uracil
  modified_base 222: mod_base = OTHER; note = uracil
  modified_base 227: mod_base = OTHER; note = uracil
  modified_base 230: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 245: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 262: mod_base = OTHER; note = uracil
  modified_base 264: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 285: mod_base = OTHER; note = uracil
  modified_base 291: mod_base = OTHER; note = uracil
tttgggataggtttaatggaggttgtagggttattagtygatttttaygtaggtttagttagtagttttttggttagttttatttttgattgtyggttttagaattgggagttgttttttggtagggttygtttttgttgggagatyggayggtgagttagttttaagttyggtattagatttttttgaggatggagtaggagttggttgttttgaggttgtaaaattttttttttygtggagatagggaggtattttagatatttatttyggatttttttgaatagggatagggaggaa

SEQ ID NO: 232 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 19: mod_base = OTHER; note = uracil
  modified_base 28: mod_base = OTHER; note = uracil
  modified_base 41: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 58: mod_base = OTHER; note = uracil
  modified_base 60: mod_base = OTHER; note = uracil
  modified_base 61: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 94: mod_base = OTHER; note = uracil
  modified_base 95: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 122: mod_base = OTHER; note = uracil
  modified_base 128: mod_base = OTHER; note = uracil
  modified_base 133: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 187: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 199: mod_base = OTHER; note = uracil
  modified_base 205: mod_base = OTHER; note = uracil
  modified_base 209: mod_base = OTHER; note = uracil
  modified_base 213: mod_base = OTHER; note = uracil
  modified_base 224: mod_base = OTHER; note = uracil
  modified_base 228: mod_base = OTHER; note = uracil
  modified_base 229: mod_base = OTHER; note = uracil
  modified_base 236: mod_base = OTHER; note = uracil
  modified_base 239: mod_base = OTHER; note = uracil
  modified_base 243: mod_base = OTHER; note = uracil
  modified_base 248: mod_base = OTHER; note = uracil
  modified_base 249: mod_base = OTHER; note = uracil
  modified_base 264: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 276: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 290: mod_base = OTHER; note = uracil
  modified_base 291: mod_base = OTHER; note = uracil
  modified_base 295: mod_base = OTHER; note = uracil
  modified_base 296: mod_base = OTHER; note = uracil
  modified_base 297: mod_base = OTHER; note = uracil
tttttttttgtttttgtttaagggagttyggggtgagtgtttgaggtgtttttttgtttttaygagggaagaagttttgtagttttagggtagttagtttttgttttatttttagaggggtttggtgtygggtttaaggttgatttatygttyggttttttagtagaggygggttttgttaggaagtagtttttagttttgaggtyggtagttaggggtggggttggttagggggttgttgattgagtttgygtaggagtyggttgatggttttgtagtttttattgagtttgttttagg

SEQ ID NO: 233 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 12: mod_base = OTHER; note = uracil
  modified_base 22: mod_base = OTHER; note = uracil
  modified_base 25: mod_base = OTHER; note = uracil
  modified_base 27: mod_base = OTHER; note = uracil
  modified_base 35: mod_base = OTHER; note = uracil
  modified_base 43: mod_base = OTHER; note = uracil
  modified_base 44: mod_base = OTHER; note = uracil
  modified_base 49: mod_base = OTHER; note = uracil
  modified_base 54: mod_base = OTHER; note = uracil
  modified_base 58: mod_base = OTHER; note = uracil
  modified_base 59: mod_base = OTHER; note = uracil
  modified_base 63: mod_base = OTHER; note = uracil
  modified_base 71: mod_base = OTHER; note = uracil
  modified_base 74: mod_base = OTHER; note = uracil
  modified_base 94: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 119: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 139: mod_base = OTHER; note = uracil
  modified_base 144: mod_base = OTHER; note = uracil
  modified_base 146: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 168: mod_base = OTHER; note = uracil
  modified_base 171: mod_base = OTHER; note = uracil
  modified_base 174: mod_base = OTHER; note = uracil
  modified_base 176: mod_base = OTHER; note = uracil
  modified_base 194: mod_base = OTHER; note = uracil
  modified_base 206: mod_base = OTHER; note = uracil
  modified_base 221: mod_base = OTHER; note = uracil
  modified_base 226: mod_base = OTHER; note = uracil
  modified_base 233: mod_base = OTHER; note = uracil
  modified_base 235: mod_base = OTHER; note = uracil
  modified_base 239: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 266: mod_base = OTHER; note = uracil
  modified_base 275: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 290: mod_base = OTHER; note = uracil
atattgtggggtagggaggggtattttttgagaataaaagatttatttttygattttttaaattggagagttttttgagagaaaagagagagataggtataggtttaygttatttatatatagttttgtgtatatagatyggatataggygtttataggtaagttygtagttgtttattttgtgaagtgaatgttgatttgggggtygggtggggttygtttgtatatygtgtattgttagattttttttgaaggatttttgttattgaagtattagaaggtttttgttttaaggtggtg

SEQ ID NO: 234 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 13: mod_base = OTHER; note = uracil
  modified_base 19: mod_base = OTHER; note = uracil
  modified_base 20: mod_base = OTHER; note = uracil
  modified_base 23: mod_base = OTHER; note = uracil
  modified_base 29: mod_base = OTHER; note = uracil
  modified_base 32: mod_base = OTHER; note = uracil
  modified_base 38: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 59: mod_base = OTHER; note = uracil
  modified_base 63: mod_base = OTHER; note = uracil
  modified_base 68: mod_base = OTHER; note = uracil
  modified_base 77: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 104: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 116: mod_base = OTHER; note = uracil
  modified_base 118: mod_base = OTHER; note = uracil
  modified_base 127: mod_base = OTHER; note = uracil
  modified_base 130: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 151: mod_base = OTHER; note = uracil
  modified_base 152: mod_base = OTHER; note = uracil
  modified_base 158: mod_base = OTHER; note = uracil
  modified_base 163: mod_base = OTHER; note = uracil
  modified_base 170: mod_base = OTHER; note = uracil
  modified_base 172: mod_base = OTHER; note = uracil
  modified_base 177: mod_base = OTHER; note = uracil
  modified_base 197: mod_base = OTHER; note = uracil
  modified_base 198: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 210: mod_base = OTHER; note = uracil
  modified_base 212: mod_base = OTHER; note = uracil
  modified_base 214: mod_base = OTHER; note = uracil
  modified_base 219: mod_base = OTHER; note = uracil
  modified_base 221: mod_base = OTHER; note = uracil
  modified_base 223: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 260: mod_base = OTHER; note = uracil
  modified_base 268: mod_base = OTHER; note = uracil
  modified_base 270: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 294: mod_base = OTHER; note = uracil
attattttagaataagggttttttgatattttagtaataaaaattttttaggaagggtttgatagtgtaygatgtatagaygaattttattyggtttttaaattagtatttattttataaaatgagtagttgygaatttgtttgtggaygtttgtgttyggtttgtgtgtatagggttgtgtgtgggtggygtggatttgtatttgtttttttttttttttttaagaagttttttagtttggaaagtygagaaatggattttttgtttttaagagatgtttttttttgttttatagtgtg

SEQ ID NO: 235 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 12: mod_base = OTHER; note = uracil
  modified_base 19: mod_base = OTHER; note = uracil
  modified_base 41: mod_base = OTHER; note = uracil
  modified_base 47: mod_base = OTHER; note = uracil
  modified_base 49: mod_base = OTHER; note = uracil
  modified_base 58: mod_base = OTHER; note = uracil
  modified_base 61: mod_base = OTHER; note = uracil
  modified_base 64: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 90: mod_base = OTHER; note = uracil
  modified_base 92: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 137: mod_base = OTHER; note = uracil
  modified_base 148: mod_base = OTHER; note = uracil
  modified_base 150: mod_base = OTHER; note = uracil
  modified_base 151: mod_base = OTHER; note = uracil
  modified_base 154: mod_base = OTHER; note = uracil
  modified_base 169: mod_base = OTHER; note = uracil
  modified_base 176: mod_base = OTHER; note = uracil
  modified_base 181: mod_base = OTHER; note = uracil
  modified_base 192: mod_base = OTHER; note = uracil
  modified_base 194: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 226: mod_base = OTHER; note = uracil
  modified_base 227: mod_base = OTHER; note = uracil
  modified_base 237: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 250: mod_base = OTHER; note = uracil
  modified_base 262: mod_base = OTHER; note = uracil
  modified_base 264: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 281: mod_base = OTHER; note = uracil
  modified_base 282: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 297: mod_base = OTHER; note = uracil
atttayggggataggggttagagtaatggagtggaaatggtaggtttataattttggttatagttgtttttatttttaagtaatttaggtttygggttggagggtggygattttaagatgyggttttagtygtyggtygtgtttgtgttttagtygatgaagygagtgtaaagggttgtataaaygygaggtattgaataaatattgagygtgtygtttagatgtttygggggaggttgaggatttatatygtggggagtgttttgtttttatggagtgatttggygttygttttttayg

SEQ ID NO: 236 - DNA, 300 bp, synthetic construct
  misc_feature 1..300: note = Synthetic polynucleotide
  source 1..300: mol_type = other DNA
  modified_base 16: mod_base = OTHER; note = uracil
  modified_base 17: mod_base = OTHER; note = uracil
  modified_base 22: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 35: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 77: mod_base = OTHER; note = uracil
  modified_base 80: mod_base = OTHER; note = uracil
  modified_base 88: mod_base = OTHER; note = uracil
  modified_base 92: mod_base = OTHER; note = uracil
  modified_base 94: mod_base = OTHER; note = uracil
  modified_base 105: mod_base = OTHER; note = uracil
  modified_base 110: mod_base = OTHER; note = uracil
  modified_base 111: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 135: mod_base = OTHER; note = uracil
  modified_base 139: mod_base = OTHER; note = uracil
  modified_base 142: mod_base = OTHER; note = uracil
  modified_base 148: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 165: mod_base = OTHER; note = uracil
  modified_base 172: mod_base = OTHER; note = uracil
  modified_base 178: mod_base = OTHER; note = uracil
  modified_base 181: mod_base = OTHER; note = uracil
  modified_base 184: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 221: mod_base = OTHER; note = uracil
  modified_base 235: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 280: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 291: mod_base = OTHER; note = uracil
  modified_base 292: mod_base = OTHER; note = uracil
  modified_base 293: mod_base = OTHER; note = uracil
ygtggagggyggaygttaggttattttatgggggtagagtattttttayggtgtggatttttagtttttttygggatatttggayggtaygtttagtgtttgtttagtgtttygygtttgtatagttttttgtattygttttatyggttggagtataaatayggtyggyggttgaggtygtattttggggtygttattttttaattyggagtttgggttgtttagagatgggagtagttgtagttaaaattgtgaatttgttatttttattttattattttgatttttgttttygtgggt

SEQ ID NO: 237 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 40: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 107: mod_base = OTHER; note = uracil
  modified_base 108: mod_base = OTHER; note = uracil
  modified_base 111: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 129: mod_base = OTHER; note = uracil
  modified_base 133: mod_base = OTHER; note = uracil
  modified_base 136: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 147: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 170: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 186: mod_base = OTHER; note = uracil
  modified_base 189: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 209: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 233: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 256: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 266: mod_base = OTHER; note = uracil
  modified_base 270: mod_base = OTHER; note = uracil
  modified_base 278: mod_base = OTHER; note = uracil
  modified_base 285: mod_base = OTHER; note = uracil
ygaggtgyggttgtttygyggttttttyggtttttygtttygygtgtttttttggagttttttttttyggaggtttttttgtttttaygtgtgtttttttttatgtttagtattygggygttttttgttttttttttgttttttggtttyggygttttygggagtgtgattttygtagyggggtgtagtttttttttgggatgagtgatyggagggaattygttttttygggtaygtygttagtttttttttttttttttttaggttattaagyggatttatgataagaaggyggtggat

SEQ ID NO: 238 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 13: mod_base = OTHER; note = uracil
  modified_base 18: mod_base = OTHER; note = uracil
  modified_base 25: mod_base = OTHER; note = uracil
  modified_base 28: mod_base = OTHER; note = uracil
  modified_base 36: mod_base = OTHER; note = uracil
  modified_base 37: mod_base = OTHER; note = uracil
  modified_base 58: mod_base = OTHER; note = uracil
  modified_base 69: mod_base = OTHER; note = uracil
  modified_base 70: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 113: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 133: mod_base = OTHER; note = uracil
  modified_base 135: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 163: mod_base = OTHER; note = uracil
  modified_base 174: mod_base = OTHER; note = uracil
  modified_base 183: mod_base = OTHER; note = uracil
  modified_base 184: mod_base = OTHER; note = uracil
  modified_base 191: mod_base = OTHER; note = uracil
  modified_base 196: mod_base = OTHER; note = uracil
  modified_base 208: mod_base = OTHER; note = uracil
  modified_base 210: mod_base = OTHER; note = uracil
  modified_base 220: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 255: mod_base = OTHER; note = uracil
  modified_base 271: mod_base = OTHER; note = uracil
  modified_base 280: mod_base = OTHER; note = uracil
  modified_base 288: mod_base = OTHER; note = uracil
  modified_base 291: mod_base = OTHER; note = uracil
  modified_base 294: mod_base = OTHER; note = uracil
  modified_base 296: mod_base = OTHER; note = uracil
  modified_base 297: mod_base = OTHER; note = uracil
atttatygtttttttgttataagttygtttgatagtttagggaagaagaggaagaggttggygaygtgttygggaaggygggtttttttyggttatttattttagaggaaagttgtatttygttgygggagttatattttyggggaygtygaagttagggaatagaagaaagataagaggygttygaatgttggatatggagaagggtataygtggaggtaggagggttttyggaaggagggattttaggaaagtaygygggaygggaagtygaggaagtygyggggtagtygtatttyg

SEQ ID NO: 239 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 12: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 47: mod_base = OTHER; note = uracil
  modified_base 59: mod_base = OTHER; note = uracil
  modified_base 60: mod_base = OTHER; note = uracil
  modified_base 68: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 102: mod_base = OTHER; note = uracil
  modified_base 106: mod_base = OTHER; note = uracil
  modified_base 109: mod_base = OTHER; note = uracil
  modified_base 115: mod_base = OTHER; note = uracil
  modified_base 116: mod_base = OTHER; note = uracil
  modified_base 120: mod_base = OTHER; note = uracil
  modified_base 129: mod_base = OTHER; note = uracil
  modified_base 139: mod_base = OTHER; note = uracil
  modified_base 141: mod_base = OTHER; note = uracil
  modified_base 144: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 175: mod_base = OTHER; note = uracil
  modified_base 179: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 210: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 221: mod_base = OTHER; note = uracil
  modified_base 225: mod_base = OTHER; note = uracil
  modified_base 234: mod_base = OTHER; note = uracil
  modified_base 236: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 259: mod_base = OTHER; note = uracil
  modified_base 260: mod_base = OTHER; note = uracil
  modified_base 265: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 281: mod_base = OTHER; note = uracil
  modified_base 297: mod_base = OTHER; note = uracil
tgtagtgtgtataggattttttgaaagggttttttgggatggagggtttttgggggggtttgtggtttttttttagtatgagttataaattatattttttatagttagtyggatttaaatygatttgatygagatyggttttttaatgyggtttttyggggtgttttygaggatttggttggatttttagagtatttgagtaagattagtaagtattttatygattyggaatatataggtagattttgttttgtggatttaaggttaggtattttgtgagttgatagttaggtgggttgt

SEQ ID NO: 240 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 9: mod_base = OTHER; note = uracil
  modified_base 13: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 24: mod_base = OTHER; note = uracil
  modified_base 31: mod_base = OTHER; note = uracil
  modified_base 32: mod_base = OTHER; note = uracil
  modified_base 36: mod_base = OTHER; note = uracil
  modified_base 37: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 52: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 71: mod_base = OTHER; note = uracil
  modified_base 87: mod_base = OTHER; note = uracil
  modified_base 91: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 108: mod_base = OTHER; note = uracil
  modified_base 110: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 128: mod_base = OTHER; note = uracil
  modified_base 129: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 149: mod_base = OTHER; note = uracil
  modified_base 152: mod_base = OTHER; note = uracil
  modified_base 162: mod_base = OTHER; note = uracil
  modified_base 167: mod_base = OTHER; note = uracil
  modified_base 173: mod_base = OTHER; note = uracil
  modified_base 188: mod_base = OTHER; note = uracil
  modified_base 192: mod_base = OTHER; note = uracil
  modified_base 196: mod_base = OTHER; note = uracil
  modified_base 218: mod_base = OTHER; note = uracil
  modified_base 220: mod_base = OTHER; note = uracil
  modified_base 224: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 277: mod_base = OTHER; note = uracil
  modified_base 285: mod_base = OTHER; note = uracil
  modified_base 286: mod_base = OTHER; note = uracil
  modified_base 291: mod_base = OTHER; note = uracil
  modified_base 293: mod_base = OTHER; note = uracil
  modified_base 295: mod_base = OTHER; note = uracil
  modified_base 298: mod_base = OTHER; note = uracil
  modified_base 300: mod_base = OTHER; note = uracil
tagtttatttaattattagtttataggatgtttagttttggatttatagggtagggtttatttgtgtatttygagtyggtgaggtatttgttggttttgtttaggtattttggaagtttagttagattttyggggatatttygggagatygtattgaagagtygatttyggttaaatyggtttggattyggttgattgtggaggatgtggtttgtgatttatgttggagaagaattataggtttttttaaaagttttttattttagggagtttttttagggagttttgtatatattgtat

SEQ ID NO: 241 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 34: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 48: mod_base = OTHER; note = uracil
  modified_base 53: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 69: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 92: mod_base = OTHER; note = uracil
  modified_base 94: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 128: mod_base = OTHER; note = uracil
  modified_base 129: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 146: mod_base = OTHER; note = uracil
  modified_base 163: mod_base = OTHER; note = uracil
  modified_base 169: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 181: mod_base = OTHER; note = uracil
  modified_base 184: mod_base = OTHER; note = uracil
  modified_base 191: mod_base = OTHER; note = uracil
  modified_base 192: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 224: mod_base = OTHER; note = uracil
  modified_base 225: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 240: mod_base = OTHER; note = uracil
  modified_base 249: mod_base = OTHER; note = uracil
  modified_base 259: mod_base = OTHER; note = uracil
  modified_base 260: mod_base = OTHER; note = uracil
  modified_base 267: mod_base = OTHER; note = uracil
  modified_base 270: mod_base = OTHER; note = uracil
  modified_base 274: mod_base = OTHER; note = uracil
  modified_base 280: mod_base = OTHER; note = uracil
  modified_base 281: mod_base = OTHER; note = uracil
  modified_base 283: mod_base = OTHER; note = uracil
aggagtttgtgatttagaaatggtaagtaaggttygatttttattaataaagtaggtatgattttagataagtttttattttgttttgggttttagttttttttttagtgaggaggtgggtgagggttttgttttttttygggaattggygatttgggaaggtagagatatttttagaattygtyggagttttgaaaatatttaygttttttgttttagtaattttgagaaaggttatattgataaagttgtgggtggttagatgatagtatttttgggttttagaygaagtgggagggg

SEQ ID NO: 242 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 15: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 31: mod_base = OTHER; note = uracil
  modified_base 35: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 52: mod_base = OTHER; note = uracil
  modified_base 58: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 73: mod_base = OTHER; note = uracil
  modified_base 81: mod_base = OTHER; note = uracil
  modified_base 87: mod_base = OTHER; note = uracil
  modified_base 106: mod_base = OTHER; note = uracil
  modified_base 111: mod_base = OTHER; note = uracil
  modified_base 113: mod_base = OTHER; note = uracil
  modified_base 123: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 151: mod_base = OTHER; note = uracil
  modified_base 152: mod_base = OTHER; note = uracil
  modified_base 157: mod_base = OTHER; note = uracil
  modified_base 158: mod_base = OTHER; note = uracil
  modified_base 169: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 192: mod_base = OTHER; note = uracil
  modified_base 204: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 217: mod_base = OTHER; note = uracil
  modified_base 228: mod_base = OTHER; note = uracil
  modified_base 233: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 277: mod_base = OTHER; note = uracil
  modified_base 278: mod_base = OTHER; note = uracil
  modified_base 283: mod_base = OTHER; note = uracil
  modified_base 289: mod_base = OTHER; note = uracil
  modified_base 291: mod_base = OTHER; note = uracil
  modified_base 295: mod_base = OTHER; note = uracil
  modified_base 297: mod_base = OTHER; note = uracil
  modified_base 298: mod_base = OTHER; note = uracil
tttttttatttygtttgaggtttaagaatgttgttatttggttatttatagttttattagtgtggttttttttaggattgttgggataaagggygtgggtgtttttaggatttyggyggattttgggaatgtttttgtttttttaaatygttagttttyggaggaggataggatttttatttatttttttattaaaggagaaattgaggtttagagtagggtagggatttgtttgaggttatgtttgttttgttggtgagaatyggattttatttattatttttgggttataggtttttt

SEQ ID NO: 243 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 9: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 71: mod_base = OTHER; note = uracil
  modified_base 73: mod_base = OTHER; note = uracil
  modified_base 78: mod_base = OTHER; note = uracil
  modified_base 84: mod_base = OTHER; note = uracil
  modified_base 94: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 119: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 154: mod_base = OTHER; note = uracil
  modified_base 156: mod_base = OTHER; note = uracil
  modified_base 158: mod_base = OTHER; note = uracil
  modified_base 160: mod_base = OTHER; note = uracil
  modified_base 162: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 184: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 211: mod_base = OTHER; note = uracil
  modified_base 213: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 255: mod_base = OTHER; note = uracil
  modified_base 259: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 288: mod_base = OTHER; note = uracil
  modified_base 293: mod_base = OTHER; note = uracil
  modified_base 294: mod_base = OTHER; note = uracil
  modified_base 297: mod_base = OTHER; note = uracil
agttttggttgagtgttttttatttttttggttygagttttttgaggaaaaaaggtggtgattttttttgtatagaataaaggttgagtgaggtatagtgtttaggggatgaggaaggttgagttygggattaggtaggaggaatttgtygtgtatttatttagatttttgtagtattyggggtaggtgttttattagygggtatagtygtttagtygtttttttatttygtygtagttagtggattattatagttgttagagaggtttattatttggttatygggtttaygtttgtaga

SEQ ID NO: 244 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 15: mod_base = OTHER; note = uracil
  modified_base 16: mod_base = OTHER; note = uracil
  modified_base 23: mod_base = OTHER; note = uracil
  modified_base 24: mod_base = OTHER; note = uracil
  modified_base 35: mod_base = OTHER; note = uracil
  modified_base 36: mod_base = OTHER; note = uracil
  modified_base 38: mod_base = OTHER; note = uracil
  modified_base 40: mod_base = OTHER; note = uracil
  modified_base 44: mod_base = OTHER; note = uracil
  modified_base 47: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 64: mod_base = OTHER; note = uracil
  modified_base 86: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 103: mod_base = OTHER; note = uracil
  modified_base 112: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 127: mod_base = OTHER; note = uracil
  modified_base 130: mod_base = OTHER; note = uracil
  modified_base 137: mod_base = OTHER; note = uracil
  modified_base 148: mod_base = OTHER; note = uracil
  modified_base 153: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 226: mod_base = OTHER; note = uracil
  modified_base 231: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 254: mod_base = OTHER; note = uracil
  modified_base 255: mod_base = OTHER; note = uracil
  modified_base 257: mod_base = OTHER; note = uracil
  modified_base 264: mod_base = OTHER; note = uracil
  modified_base 270: mod_base = OTHER; note = uracil
  modified_base 271: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 299: mod_base = OTHER; note = uracil
tttgtaggygtagattyggtggttaagtggtgggtttttttgatagttgtggtgatttattggttgyggygggatgaggaggyggttgagyggttgtgttygttggtggagtatttgtttygggtgttgtaggagtttgagtgagtgtayggtaggttttttttgtttggtttygggtttagttttttttattttttgggtattgtgttttatttagtttttgttttgtgtaggaggagttattattttttttttttagggaattygagttagggaagtggggggtatttagttagggtt

SEQ ID NO: 245 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 17: mod_base = OTHER; note = uracil
  modified_base 28: mod_base = OTHER; note = uracil
  modified_base 29: mod_base = OTHER; note = uracil
  modified_base 34: mod_base = OTHER; note = uracil
  modified_base 39: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 51: mod_base = OTHER; note = uracil
  modified_base 60: mod_base = OTHER; note = uracil
  modified_base 61: mod_base = OTHER; note = uracil
  modified_base 65: mod_base = OTHER; note = uracil
  modified_base 66: mod_base = OTHER; note = uracil
  modified_base 77: mod_base = OTHER; note = uracil
  modified_base 79: mod_base = OTHER; note = uracil
  modified_base 85: mod_base = OTHER; note = uracil
  modified_base 87: mod_base = OTHER; note = uracil
  modified_base 91: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 102: mod_base = OTHER; note = uracil
  modified_base 105: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 116: mod_base = OTHER; note = uracil
  modified_base 127: mod_base = OTHER; note = uracil
  modified_base 133: mod_base = OTHER; note = uracil
  modified_base 135: mod_base = OTHER; note = uracil
  modified_base 137: mod_base = OTHER; note = uracil
  modified_base 142: mod_base = OTHER; note = uracil
  modified_base 147: mod_base = OTHER; note = uracil
  modified_base 151: mod_base = OTHER; note = uracil
  modified_base 153: mod_base = OTHER; note = uracil
  modified_base 165: mod_base = OTHER; note = uracil
  modified_base 166: mod_base = OTHER; note = uracil
  modified_base 175: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 189: mod_base = OTHER; note = uracil
  modified_base 190: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 265: mod_base = OTHER; note = uracil
  modified_base 271: mod_base = OTHER; note = uracil
  modified_base 272: mod_base = OTHER; note = uracil
  modified_base 281: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 299: mod_base = OTHER; note = uracil
  modified_base 300: mod_base = OTHER; note = uracil
ttttgggttttttttatagggttgaggttagagttatttttagaatttygtyggaggggttttgtttggaggagggtataaygatatttatttgtttttattagttgatttagggttggggttgggttgggttatatagtttagtgttygttttaagagatgttttyggaatagttgagttatttgggttagggggtttattgtggagaggaggaggtgagtggggtggggagtagggttttatttttttttttaagttaagggtttttttttgggtgggttggggttatatttagggtt

SEQ ID NO: 246 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 43: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 131: mod_base = OTHER; note = uracil
  modified_base 138: mod_base = OTHER; note = uracil
  modified_base 141: mod_base = OTHER; note = uracil
  modified_base 143: mod_base = OTHER; note = uracil
  modified_base 154: mod_base = OTHER; note = uracil
  modified_base 156: mod_base = OTHER; note = uracil
  modified_base 161: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 193: mod_base = OTHER; note = uracil
  modified_base 196: mod_base = OTHER; note = uracil
  modified_base 206: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 236: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 257: mod_base = OTHER; note = uracil
  modified_base 267: mod_base = OTHER; note = uracil
  modified_base 269: mod_base = OTHER; note = uracil
  modified_base 273: mod_base = OTHER; note = uracil
  modified_base 274: mod_base = OTHER; note = uracil
  modified_base 276: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 300: mod_base = OTHER; note = uracil
gttttaggtgtggttttagtttatttaggaaaaagtttttagtttggagaggagggtggggttttgttttttattttatttatttttttttttttatagtggattttttggtttaggtgatttagttatttygggaatattttttagagygagtattgaattgtgtgatttagtttaattttagttttgggttagttgatggggataagtaagtgtygttgtgtttttttttaggtaaggttttttyggygggattttgagaatagttttggttttaattttgtggagagagtttagagt

SEQ ID NO: 247 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 9: mod_base = OTHER; note = uracil
  modified_base 11: mod_base = OTHER; note = uracil
  modified_base 16: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 28: mod_base = OTHER; note = uracil
  modified_base 29: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 46: mod_base = OTHER; note = uracil
  modified_base 48: mod_base = OTHER; note = uracil
  modified_base 51: mod_base = OTHER; note = uracil
  modified_base 54: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 84: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 114: mod_base = OTHER; note = uracil
  modified_base 116: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 198: mod_base = OTHER; note = uracil
  modified_base 200: mod_base = OTHER; note = uracil
  modified_base 205: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 221: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 239: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 254: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 279: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
ygttttggttttgggtttttattatygtttggggttttgtttggattttgtagttgtgttttaaggttgygttttagatttgtttatttttttttttgttttttttttgttttttttyggtttttgtagtttttttgtttttttatttaygtggttgttttgggttttatgtagtttttttttygggatgttttatgttttgttttgtgattgttttatttttgattatttttgatggttgttttagtgtaggtagaatttttaaagttttttgttttttatatgtttttttttgttatt

SEQ ID NO: 248 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 16: mod_base = OTHER; note = uracil
  modified_base 27: mod_base = OTHER; note = uracil
  modified_base 34: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 52: mod_base = OTHER; note = uracil
  modified_base 54: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 77: mod_base = OTHER; note = uracil
  modified_base 88: mod_base = OTHER; note = uracil
  modified_base 92: mod_base = OTHER; note = uracil
  modified_base 94: mod_base = OTHER; note = uracil
  modified_base 99: mod_base = OTHER; note = uracil
  modified_base 104: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 127: mod_base = OTHER; note = uracil
  modified_base 130: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 164: mod_base = OTHER; note = uracil
  modified_base 172: mod_base = OTHER; note = uracil
  modified_base 175: mod_base = OTHER; note = uracil
  modified_base 181: mod_base = OTHER; note = uracil
  modified_base 192: mod_base = OTHER; note = uracil
  modified_base 203: mod_base = OTHER; note = uracil
  modified_base 219: mod_base = OTHER; note = uracil
  modified_base 224: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 251: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 294: mod_base = OTHER; note = uracil
ggtggtaaagggggatatgtagagaatagaggattttgggggttttgtttgtattggagtagttattagaggtgattaagagtaaggtagttatagaatagagtatggggtatttygggggaggagttgtatggggtttaaggtagttaygtaggtggaggagtaggaagattatagaggtygggagaaagtagggagggggtaggggaaggagtagataaatttagggygtagttttgggatatagttgtagagtttaagtagggttttaggyggtggtgaaagtttagagttagggyg

SEQ ID NO: 249 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 51: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 94: mod_base = OTHER; note = uracil
  modified_base 96: mod_base = OTHER; note = uracil
  modified_base 104: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 124: mod_base = OTHER; note = uracil
  modified_base 125: mod_base = OTHER; note = uracil
  modified_base 132: mod_base = OTHER; note = uracil
  modified_base 135: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 156: mod_base = OTHER; note = uracil
  modified_base 159: mod_base = OTHER; note = uracil
  modified_base 161: mod_base = OTHER; note = uracil
  modified_base 163: mod_base = OTHER; note = uracil
  modified_base 165: mod_base = OTHER; note = uracil
  modified_base 169: mod_base = OTHER; note = uracil
  modified_base 173: mod_base = OTHER; note = uracil
  modified_base 175: mod_base = OTHER; note = uracil
  modified_base 182: mod_base = OTHER; note = uracil
  modified_base 193: mod_base = OTHER; note = uracil
  modified_base 194: mod_base = OTHER; note = uracil
  modified_base 198: mod_base = OTHER; note = uracil
  modified_base 241: mod_base = OTHER; note = uracil
  modified_base 252: mod_base = OTHER; note = uracil
  modified_base 259: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 298: mod_base = OTHER; note = uracil
tttttttttttttttttttttttttttagttttttttttttttttttttattgtttgatttttagttttttgatttttttttttttttttttattttttatttttttttatttttttttyggtttttttttttgttttgttatttttttygtttttttttttttttggttgatttaggggatyggaggtgggtttatttggagtgagtgagtaagtgtgttgggaggtgagggtggagggttggaggggggtagtgatttggtttgagtttttttagtattgttttagttttagtygtag

SEQ ID NO: 250 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 13: mod_base = OTHER; note = uracil
  modified_base 19: mod_base = OTHER; note = uracil
  modified_base 24: mod_base = OTHER; note = uracil
  modified_base 33: mod_base = OTHER; note = uracil
  modified_base 35: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 92: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 162: mod_base = OTHER; note = uracil
  modified_base 167: mod_base = OTHER; note = uracil
  modified_base 179: mod_base = OTHER; note = uracil
  modified_base 229: mod_base = OTHER; note = uracil
  modified_base 236: mod_base = OTHER; note = uracil
  modified_base 244: mod_base = OTHER; note = uracil
  modified_base 248: mod_base = OTHER; note = uracil
  modified_base 272: mod_base = OTHER; note = uracil
ttgyggttggggttggagtaatattggaggggtttaggttagattattgtttttttttagttttttatttttattttttaatatatttatttatttattttagataggtttattttyggttttttgagttagttagagagagaagaaaaygaaggaggtgataaagtagaaaaaaggatygggaggaggatgaaaagaaataaagagtggagaagaggaagaaaaaattagagggttaaaaattaaatagtgaaggaggaaaagggaggaattggagaaggaaggaaagagaggaggaaa

SEQ ID NO: 251 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 8: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 21: mod_base = OTHER; note = uracil
  modified_base 30: mod_base = OTHER; note = uracil
  modified_base 33: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 55: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 83: mod_base = OTHER; note = uracil
  modified_base 86: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 101: mod_base = OTHER; note = uracil
  modified_base 111: mod_base = OTHER; note = uracil
  modified_base 112: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 145: mod_base = OTHER; note = uracil
  modified_base 146: mod_base = OTHER; note = uracil
  modified_base 161: mod_base = OTHER; note = uracil
  modified_base 163: mod_base = OTHER; note = uracil
  modified_base 167: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 183: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 224: mod_base = OTHER; note = uracil
  modified_base 229: mod_base = OTHER; note = uracil
  modified_base 230: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 253: mod_base = OTHER; note = uracil
  modified_base 256: mod_base = OTHER; note = uracil
  modified_base 257: mod_base = OTHER; note = uracil
  modified_base 266: mod_base = OTHER; note = uracil
  modified_base 267: mod_base = OTHER; note = uracil
  modified_base 270: mod_base = OTHER; note = uracil
  modified_base 278: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 290: mod_base = OTHER; note = uracil
  modified_base 291: mod_base = OTHER; note = uracil
ttatatttttaggtttaggttaggggyggtagttgttttttttattgttttaygtataaatttttggttttagtttaaatygttattgtgagttttagatttgggtggggttyggagtttttttattagtattaggtgggatggttttgygaagataaagttttgtttggttttagtttaggttgtagtttygggttttgttttaggtagtttgtttaggatgttgtgttagtttttgatttttgtttattgtagttagatggggttatttgtggagttggttttttttttttagaatga

SEQ ID NO: 252 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 46: mod_base = OTHER; note = uracil
  modified_base 49: mod_base = OTHER; note = uracil
  modified_base 56: mod_base = OTHER; note = uracil
  modified_base 63: mod_base = OTHER; note = uracil
  modified_base 69: mod_base = OTHER; note = uracil
  modified_base 73: mod_base = OTHER; note = uracil
  modified_base 75: mod_base = OTHER; note = uracil
  modified_base 78: mod_base = OTHER; note = uracil
  modified_base 81: mod_base = OTHER; note = uracil
  modified_base 82: mod_base = OTHER; note = uracil
  modified_base 87: mod_base = OTHER; note = uracil
  modified_base 91: mod_base = OTHER; note = uracil
  modified_base 94: mod_base = OTHER; note = uracil
  modified_base 95: mod_base = OTHER; note = uracil
  modified_base 101: mod_base = OTHER; note = uracil
  modified_base 106: mod_base = OTHER; note = uracil
  modified_base 107: mod_base = OTHER; note = uracil
  modified_base 113: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 141: mod_base = OTHER; note = uracil
  modified_base 147: mod_base = OTHER; note = uracil
  modified_base 152: mod_base = OTHER; note = uracil
  modified_base 157: mod_base = OTHER; note = uracil
  modified_base 158: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 172: mod_base = OTHER; note = uracil
  modified_base 184: mod_base = OTHER; note = uracil
  modified_base 186: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 203: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 228: mod_base = OTHER; note = uracil
  modified_base 234: mod_base = OTHER; note = uracil
  modified_base 235: mod_base = OTHER; note = uracil
  modified_base 254: mod_base = OTHER; note = uracil
  modified_base 266: mod_base = OTHER; note = uracil
  modified_base 269: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 289: mod_base = OTHER; note = uracil
ttattttaaggagaaaaggttagttttatagatggttttatttggttgtagtgggtaaaggttagaaattggtatagtattttgggtaggttgtttggggtagggttyggggttatagtttgggttggggttagatagagttttattttygtaaggttattttatttggtgttaatgaggaggtttygggttttatttagatttggagtttatagtagyggtttggattgaaattagggatttgtgygtggggtagtgaggggggtagttgtygtttttggtttgggtttgagagtatag

SEQ ID NO: 253 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 49: mod_base = OTHER; note = uracil
  modified_base 52: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 74: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 154: mod_base = OTHER; note = uracil
  modified_base 158: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 187: mod_base = OTHER; note = uracil
  modified_base 197: mod_base = OTHER; note = uracil
  modified_base 213: mod_base = OTHER; note = uracil
  modified_base 214: mod_base = OTHER; note = uracil
  modified_base 221: mod_base = OTHER; note = uracil
  modified_base 225: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 260: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 275: mod_base = OTHER; note = uracil
  modified_base 279: mod_base = OTHER; note = uracil
  modified_base 280: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 290: mod_base = OTHER; note = uracil
  modified_base 294: mod_base = OTHER; note = uracil
  modified_base 300: mod_base = OTHER; note = uracil
aygggtgtttgtttttaagttgggtattttttttttaggttgtgggaatygttgggttattttgatttygaattagaaatagtttygattttttttttttttttygygtttttagtyggatygtttttygggattttagttaaattatagygttyggtatagggttttttttttattgtataatygttaggggagatagagaggatgggggtttygggaatatgttggggtygttagattatgggaygtaggggygtagtttatttgttggagataggttygttttttattggttgagtt

SEQ ID NO: 254 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 8: mod_base = OTHER; note = uracil
  modified_base 9: mod_base = OTHER; note = uracil
  modified_base 23: mod_base = OTHER; note = uracil
  modified_base 24: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 42: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 64: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 83: mod_base = OTHER; note = uracil
  modified_base 84: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 102: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 123: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 144: mod_base = OTHER; note = uracil
  modified_base 151: mod_base = OTHER; note = uracil
  modified_base 162: mod_base = OTHER; note = uracil
  modified_base 169: mod_base = OTHER; note = uracil
  modified_base 170: mod_base = OTHER; note = uracil
  modified_base 182: mod_base = OTHER; note = uracil
  modified_base 186: mod_base = OTHER; note = uracil
  modified_base 219: mod_base = OTHER; note = uracil
  modified_base 225: mod_base = OTHER; note = uracil
  modified_base 237: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 290: mod_base = OTHER; note = uracil
  modified_base 294: mod_base = OTHER; note = uracil
  modified_base 296: mod_base = OTHER; note = uracil
  modified_base 297: mod_base = OTHER; note = uracil
gatttagttagtgaggagygggtttgtttttaataggtgagttaygtttttaygttttatagtttggygattttagtatgttttygggatttttattttttttgttttttttagyggttgtgtaataagggagaggttttatgtyggaygttgtggtttggttggggtttyggggggyggttyggttgggggygyggggagaaagaggggggtyggggttatttttggttygaggttagaatggtttagyggtttttatagtttgggggaggggtgtttagtttgggagtagatattygt

SEQ ID NO: 255 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 22: mod_base = OTHER; note = uracil
  modified_base 39: mod_base = OTHER; note = uracil
  modified_base 54: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 79: mod_base = OTHER; note = uracil
  modified_base 88: mod_base = OTHER; note = uracil
  modified_base 93: mod_base = OTHER; note = uracil
  modified_base 94: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 110: mod_base = OTHER; note = uracil
  modified_base 122: mod_base = OTHER; note = uracil
  modified_base 123: mod_base = OTHER; note = uracil
  modified_base 127: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 149: mod_base = OTHER; note = uracil
  modified_base 155: mod_base = OTHER; note = uracil
  modified_base 165: mod_base = OTHER; note = uracil
  modified_base 170: mod_base = OTHER; note = uracil
  modified_base 180: mod_base = OTHER; note = uracil
  modified_base 185: mod_base = OTHER; note = uracil
  modified_base 212: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 279: mod_base = OTHER; note = uracil
  modified_base 281: mod_base = OTHER; note = uracil
gtagtaaatagttttattgtataaatatatagygygggttgggygggggyggttaatttyggttttttggtayggggatagggygygttgggttyggttttgtagygagtyggtgggagggtttagttgtggtttaggyggtgttgagtaygggtygggggygttatagtyggggagggtygggtagygagygggtgggygaggggygagttatygtttgtttygttyggaggggatttyggygggtgagggaygtgggtggagggagaygtggggagtttagtyggagtagatgatgaa

SEQ ID NO: 256 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 6: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 18: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 33: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 81: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 147: mod_base = OTHER; note = uracil
  modified_base 148: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 175: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 192: mod_base = OTHER; note = uracil
  modified_base 196: mod_base = OTHER; note = uracil
  modified_base 199: mod_base = OTHER; note = uracil
  modified_base 204: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 232: mod_base = OTHER; note = uracil
  modified_base 239: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 282: mod_base = OTHER; note = uracil
  modified_base 290: mod_base = OTHER; note = uracil
  modified_base 297: mod_base = OTHER; note = uracil
  modified_base 300: mod_base = OTHER; note = uracil
tttattatttatttygattgagttttttaygtttttttttatttaygttttttattygtyggggtttttttygggyggggtagaygatgattygtttttygtttattygttygttgttyggtttttttyggttatgaygttttyggttygtgtttaatatygtttgggttatagttaggtttttttatyggttygttgtagagtygggtttagygygttttgttttygtgttagggaatyggggttgatygttttygtttagttygygttatatatttgtataataggattgtttattgt

SEQ ID NO: 257 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 27: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 45: mod_base = OTHER; note = uracil
  modified_base 46: mod_base = OTHER; note = uracil
  modified_base 48: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 61: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 92: mod_base = OTHER; note = uracil
  modified_base 98: mod_base = OTHER; note = uracil
  modified_base 99: mod_base = OTHER; note = uracil
  modified_base 106: mod_base = OTHER; note = uracil
  modified_base 115: mod_base = OTHER; note = uracil
  modified_base 118: mod_base = OTHER; note = uracil
  modified_base 126: mod_base = OTHER; note = uracil
  modified_base 130: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 180: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 217: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 259: mod_base = OTHER; note = uracil
  modified_base 266: mod_base = OTHER; note = uracil
  modified_base 284: mod_base = OTHER; note = uracil
agttatttaatatatggttttagtggtattaatttgttattaagttttatgttttttatttataaaatggagattataattatatttgttgtaaaatttaaaatttagaggtttttatagygtgatygatattgtgtttyggagagtttyggtttttttttggttttggttttttggaataygtgatgtttagtttaaatagtgttatattttgttttataatgttttaaygagagttataattaaagatttttgagttagaggataatagaggaggtgggaattgggtaaayggagagt

SEQ ID NO: 258 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 43: mod_base = OTHER; note = uracil
  modified_base 45: mod_base = OTHER; note = uracil
  modified_base 52: mod_base = OTHER; note = uracil
  modified_base 64: mod_base = OTHER; note = uracil
  modified_base 66: mod_base = OTHER; note = uracil
  modified_base 76: mod_base = OTHER; note = uracil
  modified_base 86: mod_base = OTHER; note = uracil
  modified_base 96: mod_base = OTHER; note = uracil
  modified_base 98: mod_base = OTHER; note = uracil
  modified_base 107: mod_base = OTHER; note = uracil
  modified_base 112: mod_base = OTHER; note = uracil
  modified_base 115: mod_base = OTHER; note = uracil
  modified_base 123: mod_base = OTHER; note = uracil
  modified_base 124: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 148: mod_base = OTHER; note = uracil
  modified_base 154: mod_base = OTHER; note = uracil
  modified_base 156: mod_base = OTHER; note = uracil
  modified_base 158: mod_base = OTHER; note = uracil
  modified_base 164: mod_base = OTHER; note = uracil
  modified_base 166: mod_base = OTHER; note = uracil
  modified_base 176: mod_base = OTHER; note = uracil
  modified_base 180: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 209: mod_base = OTHER; note = uracil
  modified_base 212: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 249: mod_base = OTHER; note = uracil
  modified_base 256: mod_base = OTHER; note = uracil
  modified_base 264: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 283: mod_base = OTHER; note = uracil
  modified_base 284: mod_base = OTHER; note = uracil
  modified_base 298: mod_base = OTHER; note = uracil
tttttygtttatttagtttttattttttttattgttttttgatttaaaaatttttggttgtgattttygttgaggtattgtagagtagggtgtggtattgtttgggttgggtattaygtgttttagggggttagagttaggagagggtygaaatttttyggggtatagtgtyggttaygttgtagaaatttttgaattttggattttgtagtaggtatgattgtggtttttattttatggatggagaatatgaggtttagtgataggttagtgttattggggttatgtattaaataattg

SEQ ID NO: 259 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 21: mod_base = OTHER; note = uracil
  modified_base 23: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 37: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 77: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 95: mod_base = OTHER; note = uracil
  modified_base 97: mod_base = OTHER; note = uracil
  modified_base 100: mod_base = OTHER; note = uracil
  modified_base 101: mod_base = OTHER; note = uracil
  modified_base 116: mod_base = OTHER; note = uracil
  modified_base 123: mod_base = OTHER; note = uracil
  modified_base 141: mod_base = OTHER; note = uracil
  modified_base 158: mod_base = OTHER; note = uracil
  modified_base 159: mod_base = OTHER; note = uracil
  modified_base 164: mod_base = OTHER; note = uracil
  modified_base 165: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 211: mod_base = OTHER; note = uracil
  modified_base 212: mod_base = OTHER; note = uracil
  modified_base 219: mod_base = OTHER; note = uracil
  modified_base 231: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 255: mod_base = OTHER; note = uracil
  modified_base 265: mod_base = OTHER; note = uracil
  modified_base 274: mod_base = OTHER; note = uracil
  modified_base 296: mod_base = OTHER; note = uracil
gagtttyggtttttttttggttttggttttttggaataygtgatgtttagtttaaatagtgttatattttgttttataatgttttaaygagagttataattaaagatttttgagttagaggataatagaggaggtgggaattgggtaaayggagagtttatggtttttggaggtggggtatagttyggagtgaatgagggtttagagtttttagagaatygaatatagatttgtgtgtgaagtttttagatattttaatgttgataaygaaattaaattgaaaaaaaataaaaattaata

SEQ ID NO: 260 - DNA, 300 bp, synthetic construct
  misc_feature 1..300: note = Synthetic polynucleotide
  source 1..300: mol_type = other DNA
  modified_base 20: mod_base = OTHER; note = uracil
  modified_base 37: mod_base = OTHER; note = uracil
  modified_base 40: mod_base = OTHER; note = uracil
  modified_base 51: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 65: mod_base = OTHER; note = uracil
  modified_base 67: mod_base = OTHER; note = uracil
  modified_base 72: mod_base = OTHER; note = uracil
  modified_base 84: mod_base = OTHER; note = uracil
  modified_base 86: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 108: mod_base = OTHER; note = uracil
  modified_base 110: mod_base = OTHER; note = uracil
  modified_base 112: mod_base = OTHER; note = uracil
  modified_base 117: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 186: mod_base = OTHER; note = uracil
  modified_base 188: mod_base = OTHER; note = uracil
  modified_base 195: mod_base = OTHER; note = uracil
  modified_base 207: mod_base = OTHER; note = uracil
  modified_base 209: mod_base = OTHER; note = uracil
  modified_base 219: mod_base = OTHER; note = uracil
  modified_base 229: mod_base = OTHER; note = uracil
  modified_base 239: mod_base = OTHER; note = uracil
  modified_base 241: mod_base = OTHER; note = uracil
  modified_base 250: mod_base = OTHER; note = uracil
  modified_base 255: mod_base = OTHER; note = uracil
  modified_base 258: mod_base = OTHER; note = uracil
  modified_base 266: mod_base = OTHER; note = uracil
  modified_base 267: mod_base = OTHER; note = uracil
  modified_base 274: mod_base = OTHER; note = uracil
  modified_base 275: mod_base = OTHER; note = uracil
  modified_base 280: mod_base = OTHER; note = uracil
  modified_base 281: mod_base = OTHER; note = uracil
  modified_base 291: mod_base = OTHER; note = uracil
  modified_base 297: mod_base = OTHER; note = uracil
  modified_base 299: mod_base = OTHER; note = uracil
attgatttttatttttttttaatttgatttygttgttaatattagaatatttggaggttttatatatagatttatattyggttttttggaaattttgggtttttatttatttygggttgtgttttatttttaaaggttatggatttttygtttatttagtttttattttttttattgttttttgatttaaaaatttttggttgtgattttygttgaggtattgtagagtagggtgtggtattgtttgggttgggtattaygtgttttagggggttagagttaggagagggtygaaatttt

SEQ ID NO: 261 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 22: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 123: mod_base = OTHER; note = uracil
  modified_base 125: mod_base = OTHER; note = uracil
  modified_base 126: mod_base = OTHER; note = uracil
  modified_base 136: mod_base = OTHER; note = uracil
  modified_base 139: mod_base = OTHER; note = uracil
  modified_base 143: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 182: mod_base = OTHER; note = uracil
  modified_base 190: mod_base = OTHER; note = uracil
  modified_base 191: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 224: mod_base = OTHER; note = uracil
  modified_base 227: mod_base = OTHER; note = uracil
  modified_base 235: mod_base = OTHER; note = uracil
  modified_base 236: mod_base = OTHER; note = uracil
  modified_base 241: mod_base = OTHER; note = uracil
  modified_base 244: mod_base = OTHER; note = uracil
  modified_base 252: mod_base = OTHER; note = uracil
  modified_base 253: mod_base = OTHER; note = uracil
  modified_base 261: mod_base = OTHER; note = uracil
  modified_base 263: mod_base = OTHER; note = uracil
  modified_base 276: mod_base = OTHER; note = uracil
  modified_base 281: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 298: mod_base = OTHER; note = uracil
ygggtgyggattygttatttgtygtatttttttttttttaattttgttttttttttatttttattttattttttatttttaattttygttyggygttttattttygattttgtttgttygggtatttyggggygttygttygtyggtttygtttttatttgtttyggtaggygygygtgggttyggygtttygygtttttttttygattgtgyggttttygygttgtygggttttttgtttaataatataattagggaggtatyggyggagagygtygggtagaattttttttyggattg

SEQ ID NO: 262 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 28: mod_base = OTHER; note = uracil
  modified_base 30: mod_base = OTHER; note = uracil
  modified_base 32: mod_base = OTHER; note = uracil
  modified_base 35: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 63: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 86: mod_base = OTHER; note = uracil
  modified_base 89: mod_base = OTHER; note = uracil
  modified_base 91: mod_base = OTHER; note = uracil
  modified_base 115: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 140: mod_base = OTHER; note = uracil
  modified_base 155: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 179: mod_base = OTHER; note = uracil
  modified_base 180: mod_base = OTHER; note = uracil
  modified_base 185: mod_base = OTHER; note = uracil
  modified_base 189: mod_base = OTHER; note = uracil
  modified_base 208: mod_base = OTHER; note = uracil
  modified_base 255: mod_base = OTHER; note = uracil
  modified_base 280: mod_base = OTHER; note = uracil
  modified_base 292: mod_base = OTHER; note = uracil
  modified_base 295: mod_base = OTHER; note = uracil
  modified_base 297: mod_base = OTHER; note = uracil
  modified_base 298: mod_base = OTHER; note = uracil
tagttygggaggaagttttgttyggygtttttygtyggtgtttttttggttatattgttgaataggaaattyggtagygygggagtygtatagtygaggagggagygygggaygtygagtttaygygygtttgtyggggtaagtggaggygaagtyggygagyggaygtttygaggtgttygggtaggtagggtygggagtggggygtygagygggggttgggggtgggaagtggggtgggggtggggaaagggtagggttgggaagggaagggtgyggtaggtggygggttygtattyg

SEQ ID NO: 263 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 8: mod_base = OTHER; note = uracil
  modified_base 12: mod_base = OTHER; note = uracil
  modified_base 19: mod_base = OTHER; note = uracil
  modified_base 23: mod_base = OTHER; note = uracil
  modified_base 25: mod_base = OTHER; note = uracil
  modified_base 30: mod_base = OTHER; note = uracil
  modified_base 37: mod_base = OTHER; note = uracil
  modified_base 38: mod_base = OTHER; note = uracil
  modified_base 50: mod_base = OTHER; note = uracil
  modified_base 52: mod_base = OTHER; note = uracil
  modified_base 60: mod_base = OTHER; note = uracil
  modified_base 71: mod_base = OTHER; note = uracil
  modified_base 76: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 95: mod_base = OTHER; note = uracil
  modified_base 103: mod_base = OTHER; note = uracil
  modified_base 110: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 166: mod_base = OTHER; note = uracil
  modified_base 169: mod_base = OTHER; note = uracil
  modified_base 195: mod_base = OTHER; note = uracil
  modified_base 198: mod_base = OTHER; note = uracil
  modified_base 203: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 226: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 241: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 263: mod_base = OTHER; note = uracil
  modified_base 264: mod_base = OTHER; note = uracil
  modified_base 275: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 300: mod_base = OTHER; note = uracil
ggtaaggtagtttgggygtygttttyggtttyggggtttgyggtyggggtatygyggtgtygygtttgagtyggttagttttttgyggaaattataggggygttyggygttgyggtygygtttttyggggtagygttygttggttggaggygtttaaattgaaagtagttttggggagagggggyggaygygggtygtygagtaaggggagggggyggttyggtatagygattttattgtttgtgttygtygaggggtggaattttgyggtgagttyggygyggygtttttttttygagt

SEQ ID NO: 264 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 17: mod_base = OTHER; note = uracil
  modified_base 22: mod_base = OTHER; note = uracil
  modified_base 27: mod_base = OTHER; note = uracil
  modified_base 29: mod_base = OTHER; note = uracil
  modified_base 31: mod_base = OTHER; note = uracil
  modified_base 34: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 56: mod_base = OTHER; note = uracil
  modified_base 58: mod_base = OTHER; note = uracil
  modified_base 62: mod_base = OTHER; note = uracil
  modified_base 73: mod_base = OTHER; note = uracil
  modified_base 78: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 99: mod_base = OTHER; note = uracil
  modified_base 107: mod_base = OTHER; note = uracil
  modified_base 108: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 136: mod_base = OTHER; note = uracil
  modified_base 140: mod_base = OTHER; note = uracil
  modified_base 151: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 186: mod_base = OTHER; note = uracil
  modified_base 189: mod_base = OTHER; note = uracil
  modified_base 194: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 213: mod_base = OTHER; note = uracil
  modified_base 216: mod_base = OTHER; note = uracil
  modified_base 223: mod_base = OTHER; note = uracil
  modified_base 227: mod_base = OTHER; note = uracil
  modified_base 231: mod_base = OTHER; note = uracil
  modified_base 233: mod_base = OTHER; note = uracil
  modified_base 242: mod_base = OTHER; note = uracil
  modified_base 244: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 261: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 273: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 291: mod_base = OTHER; note = uracil
  modified_base 294: mod_base = OTHER; note = uracil
  modified_base 295: mod_base = OTHER; note = uracil
  modified_base 299: mod_base = OTHER; note = uracil
  modified_base 300: mod_base = OTHER; note = uracil
gttyggggagggggygtygygtygagtttatygtaaggttttatttttyggygggtatagataatggggtygttgtgtygggtygttttttttttttgttyggyggttygygttygttttttttttttaaagttgtttttaatttaaaygtttttaattagygggygttgtttyggggggygygatygtagygtygagygtttttgtaattttygtagggagttgatyggtttaaaygyggtatygyggtgtttygatygtaggtttygagatyggagayggygtttagattgttttgtt

SEQ ID NO: 265 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 22: mod_base = OTHER; note = uracil
  modified_base 36: mod_base = OTHER; note = uracil
  modified_base 45: mod_base = OTHER; note = uracil
  modified_base 46: mod_base = OTHER; note = uracil
  modified_base 52: mod_base = OTHER; note = uracil
  modified_base 59: mod_base = OTHER; note = uracil
  modified_base 64: mod_base = OTHER; note = uracil
  modified_base 75: mod_base = OTHER; note = uracil
  modified_base 80: mod_base = OTHER; note = uracil
  modified_base 82: mod_base = OTHER; note = uracil
  modified_base 84: mod_base = OTHER; note = uracil
  modified_base 89: mod_base = OTHER; note = uracil
  modified_base 101: mod_base = OTHER; note = uracil
  modified_base 104: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 159: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 185: mod_base = OTHER; note = uracil
  modified_base 195: mod_base = OTHER; note = uracil
  modified_base 201: mod_base = OTHER; note = uracil
  modified_base 204: mod_base = OTHER; note = uracil
  modified_base 215: mod_base = OTHER; note = uracil
  modified_base 222: mod_base = OTHER; note = uracil
  modified_base 228: mod_base = OTHER; note = uracil
  modified_base 230: mod_base = OTHER; note = uracil
  modified_base 232: mod_base = OTHER; note = uracil
  modified_base 235: mod_base = OTHER; note = uracil
  modified_base 239: mod_base = OTHER; note = uracil
  modified_base 241: mod_base = OTHER; note = uracil
  modified_base 245: mod_base = OTHER; note = uracil
  modified_base 249: mod_base = OTHER; note = uracil
  modified_base 251: mod_base = OTHER; note = uracil
  modified_base 262: mod_base = OTHER; note = uracil
  modified_base 284: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 298: mod_base = OTHER; note = uracil
ggagggagtttgtattttgggtagtgatgtggagttagagatttttaagtttatggtgtaagtttgtgggagagtagaatttattttataaaattgttgatagtyggtgttgttagagayggaaagggataatttyggtttttttttaggygtggagtttgtggggatgtgtttttagaaaatgtagggttaagtaggagttgtagagtagaattaaatgataatgatttattgttgttattaataggttttttgtgggggttgtaggtgggaggygatatggtyggtattttygtataa

SEQ ID NO: 266 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 18: mod_base = OTHER; note = uracil
  modified_base 19: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 53: mod_base = OTHER; note = uracil
  modified_base 54: mod_base = OTHER; note = uracil
  modified_base 64: mod_base = OTHER; note = uracil
  modified_base 67: mod_base = OTHER; note = uracil
  modified_base 75: mod_base = OTHER; note = uracil
  modified_base 81: mod_base = OTHER; note = uracil
  modified_base 90: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 123: mod_base = OTHER; note = uracil
  modified_base 130: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 163: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 179: mod_base = OTHER; note = uracil
  modified_base 183: mod_base = OTHER; note = uracil
  modified_base 185: mod_base = OTHER; note = uracil
  modified_base 189: mod_base = OTHER; note = uracil
  modified_base 192: mod_base = OTHER; note = uracil
  modified_base 194: mod_base = OTHER; note = uracil
  modified_base 198: mod_base = OTHER; note = uracil
  modified_base 202: mod_base = OTHER; note = uracil
  modified_base 205: mod_base = OTHER; note = uracil
  modified_base 224: mod_base = OTHER; note = uracil
  modified_base 227: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 239: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 252: mod_base = OTHER; note = uracil
  modified_base 261: mod_base = OTHER; note = uracil
  modified_base 263: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 275: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 289: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
ttgtgygaaggtgtyggttatatygttttttatttatagtttttataaagagtttgttagtgatagtagtgagttattgttatttgattttattttgtagtttttgtttaattttgtattttttggaagtatatttttatagattttaygtttggagaggagtyggggttgttttttttygtttttaataatatyggttgttaataattttgtaaagtgagttttgtttttttatagatttgtattatgaatttggaaatttttgattttatattattgtttagagtgtaggtttttttt

SEQ ID NO: 267 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 13: mod_base = OTHER; note = uracil
  modified_base 24: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 41: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 59: mod_base = OTHER; note = uracil
  modified_base 60: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 80: mod_base = OTHER; note = uracil
  modified_base 82: mod_base = OTHER; note = uracil
  modified_base 84: mod_base = OTHER; note = uracil
  modified_base 93: mod_base = OTHER; note = uracil
  modified_base 94: mod_base = OTHER; note = uracil
  modified_base 97: mod_base = OTHER; note = uracil
  modified_base 106: mod_base = OTHER; note = uracil
  modified_base 107: mod_base = OTHER; note = uracil
  modified_base 122: mod_base = OTHER; note = uracil
  modified_base 124: mod_base = OTHER; note = uracil
  modified_base 130: mod_base = OTHER; note = uracil
  modified_base 133: mod_base = OTHER; note = uracil
  modified_base 135: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 183: mod_base = OTHER; note = uracil
  modified_base 184: mod_base = OTHER; note = uracil
  modified_base 191: mod_base = OTHER; note = uracil
  modified_base 200: mod_base = OTHER; note = uracil
  modified_base 201: mod_base = OTHER; note = uracil
  modified_base 221: mod_base = OTHER; note = uracil
  modified_base 228: mod_base = OTHER; note = uracil
  modified_base 233: mod_base = OTHER; note = uracil
  modified_base 235: mod_base = OTHER; note = uracil
  modified_base 243: mod_base = OTHER; note = uracil
  modified_base 248: mod_base = OTHER; note = uracil
  modified_base 250: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 276: mod_base = OTHER; note = uracil
  modified_base 277: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 292: mod_base = OTHER; note = uracil
  modified_base 295: mod_base = OTHER; note = uracil
gttttggttyggtagagtggyggtaattttgtttttttttttagaatatttaaagaagttagtgagtgagttgtttatgtatatyggggagatttatagayggatttaggaggagygggagtttattgattgtatatttttaattyggygtgataggaaagtgaggttatttgttttaagtgttygggggtaggggggtttatggaggagggggygggggtaggtgtttggatatagggatgttggttttaggtggtatagttggggagaaaaaatttatttattgtaaaatattattag

SEQ ID NO: 268 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 118: mod_base = OTHER; note = uracil
  modified_base 120: mod_base = OTHER; note = uracil
  modified_base 127: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 152: mod_base = OTHER; note = uracil
  modified_base 168: mod_base = OTHER; note = uracil
  modified_base 172: mod_base = OTHER; note = uracil
  modified_base 179: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 197: mod_base = OTHER; note = uracil
  modified_base 201: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 221: mod_base = OTHER; note = uracil
  modified_base 227: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 236: mod_base = OTHER; note = uracil
  modified_base 238: mod_base = OTHER; note = uracil
  modified_base 242: mod_base = OTHER; note = uracil
  modified_base 245: mod_base = OTHER; note = uracil
  modified_base 256: mod_base = OTHER; note = uracil
  modified_base 269: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 285: mod_base = OTHER; note = uracil
  modified_base 288: mod_base = OTHER; note = uracil
  modified_base 293: mod_base = OTHER; note = uracil
  modified_base 294: mod_base = OTHER; note = uracil
  modified_base 299: mod_base = OTHER; note = uracil
taatgatgttttgtaatggataggttttttttttttagttgtgttatttgagattagtatttttgtgtttagatatttgttttygtttttttttttatggatttttttgttttygggtatttaggataggtggttttatttttttattaygtygggttggaagtgtgtagttaatgagttttygttttttttggattygtttgtaggttttttyggtgtgtatgagtagtttatttattggtttttttaggtgttttagagagagaggtaagattgtygttattttgtygaattagaata

SEQ ID NO: 269 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 13: mod_base = OTHER; note = uracil
  modified_base 20: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 44: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 74: mod_base = OTHER; note = uracil
  modified_base 79: mod_base = OTHER; note = uracil
  modified_base 80: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 108: mod_base = OTHER; note = uracil
  modified_base 112: mod_base = OTHER; note = uracil
  modified_base 119: mod_base = OTHER; note = uracil
  modified_base 125: mod_base = OTHER; note = uracil
  modified_base 128: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 160: mod_base = OTHER; note = uracil
  modified_base 161: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 183: mod_base = OTHER; note = uracil
  modified_base 185: mod_base = OTHER; note = uracil
  modified_base 189: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 217: mod_base = OTHER; note = uracil
  modified_base 230: mod_base = OTHER; note = uracil
  modified_base 231: mod_base = OTHER; note = uracil
  modified_base 247: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 267: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 283: mod_base = OTHER; note = uracil
  modified_base 286: mod_base = OTHER; note = uracil
  modified_base 290: mod_base = OTHER; note = uracil
  modified_base 292: mod_base = OTHER; note = uracil
  modified_base 296: mod_base = OTHER; note = uracil
  modified_base 299: mod_base = OTHER; note = uracil
  modified_base 300: mod_base = OTHER; note = uracil
ygtgattagagatagaaattagtttttttttttttttattgagtttgtagttattttaagtataatttgtgttttgtgttagttttattataaattagttttgagttttattyggyggtttattttgttgttaaaatttttattagttgygggaatgggttagggagagagttyggattttatttyggttgtggtgatttaygtttttgggaagggttgaggtatttgtttttggatgtggggatgttgtggtttttggttgggaatatagtttygttttgtttgttggttttggttttt

SEQ ID NO: 270 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 12: mod_base = OTHER; note = uracil
  modified_base 13: mod_base = OTHER; note = uracil
  modified_base 16: mod_base = OTHER; note = uracil
  modified_base 20: mod_base = OTHER; note = uracil
  modified_base 30: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 113: mod_base = OTHER; note = uracil
  modified_base 125: mod_base = OTHER; note = uracil
  modified_base 130: mod_base = OTHER; note = uracil
  modified_base 132: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 155: mod_base = OTHER; note = uracil
  modified_base 171: mod_base = OTHER; note = uracil
  modified_base 174: mod_base = OTHER; note = uracil
  modified_base 183: mod_base = OTHER; note = uracil
  modified_base 186: mod_base = OTHER; note = uracil
  modified_base 196: mod_base = OTHER; note = uracil
  modified_base 198: mod_base = OTHER; note = uracil
  modified_base 203: mod_base = OTHER; note = uracil
  modified_base 219: mod_base = OTHER; note = uracil
  modified_base 223: mod_base = OTHER; note = uracil
  modified_base 225: mod_base = OTHER; note = uracil
  modified_base 230: mod_base = OTHER; note = uracil
  modified_base 232: mod_base = OTHER; note = uracil
  modified_base 241: mod_base = OTHER; note = uracil
  modified_base 251: mod_base = OTHER; note = uracil
  modified_base 254: mod_base = OTHER; note = uracil
  modified_base 258: mod_base = OTHER; note = uracil
  modified_base 260: mod_base = OTHER; note = uracil
  modified_base 279: mod_base = OTHER; note = uracil
  modified_base 286: mod_base = OTHER; note = uracil
  modified_base 290: mod_base = OTHER; note = uracil
  modified_base 292: mod_base = OTHER; note = uracil
  modified_base 297: mod_base = OTHER; note = uracil
ggaagttagagttagtagataaaaygaggttgtgtttttaattagaggttatagtatttttatatttaaggataaatattttagttttttttaaaggygtgagttattatagtyggagtaaagttygggttttttttttggtttattttygtaattaatgaaggttttggtagtagaataagtygtyggatagaatttagggttgatttatggtggaattggtataggatataggttatatttaaagtggttataagtttagtgagggaggaggggagttgatttttgtttttgattayg

SEQ ID NO: 271 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 15: mod_base = OTHER; note = uracil
  modified_base 16: mod_base = OTHER; note = uracil
  modified_base 25: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 50: mod_base = OTHER; note = uracil
  modified_base 53: mod_base = OTHER; note = uracil
  modified_base 54: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 65: mod_base = OTHER; note = uracil
  modified_base 67: mod_base = OTHER; note = uracil
  modified_base 78: mod_base = OTHER; note = uracil
  modified_base 83: mod_base = OTHER; note = uracil
  modified_base 85: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 114: mod_base = OTHER; note = uracil
  modified_base 118: mod_base = OTHER; note = uracil
  modified_base 122: mod_base = OTHER; note = uracil
  modified_base 127: mod_base = OTHER; note = uracil
  modified_base 132: mod_base = OTHER; note = uracil
  modified_base 135: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 159: mod_base = OTHER; note = uracil
  modified_base 163: mod_base = OTHER; note = uracil
  modified_base 166: mod_base = OTHER; note = uracil
  modified_base 170: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 187: mod_base = OTHER; note = uracil
  modified_base 201: mod_base = OTHER; note = uracil
  modified_base 203: mod_base = OTHER; note = uracil
  modified_base 213: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 242: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 263: mod_base = OTHER; note = uracil
  modified_base 269: mod_base = OTHER; note = uracil
  modified_base 272: mod_base = OTHER; note = uracil
  modified_base 288: mod_base = OTHER; note = uracil
  modified_base 298: mod_base = OTHER; note = uracil
tagtatgtatgtgtttatttaaggtatttgagttttggtttttgttgttttttttttttttttttttygtygggttgttgagtttaatattttatygggtttttgttttttagttagtagttagtgtagagttgttgggtttttttgtttygtttgggtaggtttttgttaatgagttattaagtatygggaaataagtgtataggaaggagtaggtggtaagattttgtggaggtagagatagttttatttagtgagtgagttgtgattgtaaatttgggaaggttttgggggaagtaa

SEQ ID NO: 272 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 30: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 41: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 57: mod_base = OTHER; note = uracil
  modified_base 61: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 78: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 101: mod_base = OTHER; note = uracil
  modified_base 103: mod_base = OTHER; note = uracil
  modified_base 110: mod_base = OTHER; note = uracil
  modified_base 111: mod_base = OTHER; note = uracil
  modified_base 117: mod_base = OTHER; note = uracil
  modified_base 125: mod_base = OTHER; note = uracil
  modified_base 127: mod_base = OTHER; note = uracil
  modified_base 133: mod_base = OTHER; note = uracil
  modified_base 139: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 154: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 167: mod_base = OTHER; note = uracil
  modified_base 170: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 181: mod_base = OTHER; note = uracil
  modified_base 184: mod_base = OTHER; note = uracil
  modified_base 188: mod_base = OTHER; note = uracil
  modified_base 196: mod_base = OTHER; note = uracil
  modified_base 202: mod_base = OTHER; note = uracil
  modified_base 203: mod_base = OTHER; note = uracil
  modified_base 219: mod_base = OTHER; note = uracil
  modified_base 221: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 254: mod_base = OTHER; note = uracil
  modified_base 257: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 271: mod_base = OTHER; note = uracil
  modified_base 277: mod_base = OTHER; note = uracil
  modified_base 278: mod_base = OTHER; note = uracil
  modified_base 288: mod_base = OTHER; note = uracil
  modified_base 290: mod_base = OTHER; note = uracil
  modified_base 294: mod_base = OTHER; note = uracil
  modified_base 298: mod_base = OTHER; note = uracil
ttgttttttttagaatttttttaaatttgtagttatagtttatttattgaatggaattgtttttatttttatagggttttgttatttgtttttttttgtgtatttatttttyggtgtttggtgatttattgatagaagtttgtttaagygaggtagaaggatttagtagttttgtattgattgttagttaaggagtaggagttyggtgggatgttgagtttagtaattygayggagaaagaaggaaggaagaatagtaaaggttagggtttagatgttttaaatggatatatgtatattg

SEQ ID NO: 273 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 16: mod_base = OTHER; note = uracil
  modified_base 17: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 36: mod_base = OTHER; note = uracil
  modified_base 50: mod_base = OTHER; note = uracil
  modified_base 58: mod_base = OTHER; note = uracil
  modified_base 61: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 96: mod_base = OTHER; note = uracil
  modified_base 106: mod_base = OTHER; note = uracil
  modified_base 109: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 136: mod_base = OTHER; note = uracil
  modified_base 157: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 167: mod_base = OTHER; note = uracil
  modified_base 172: mod_base = OTHER; note = uracil
  modified_base 180: mod_base = OTHER; note = uracil
  modified_base 181: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 214: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 227: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 245: mod_base = OTHER; note = uracil
  modified_base 246: mod_base = OTHER; note = uracil
  modified_base 253: mod_base = OTHER; note = uracil
  modified_base 259: mod_base = OTHER; note = uracil
  modified_base 270: mod_base = OTHER; note = uracil
  modified_base 276: mod_base = OTHER; note = uracil
  modified_base 281: mod_base = OTHER; note = uracil
  modified_base 288: mod_base = OTHER; note = uracil
  modified_base 293: mod_base = OTHER; note = uracil
  modified_base 299: mod_base = OTHER; note = uracil
  modified_base 300: mod_base = OTHER; note = uracil
yggtygyggggggygtttggaggagggaagttttttyggaggagaagagttgggyggtygtygtaggaggaagyggaaagataaggggttttyggttyggyggggtygtyggaygtttaggagttttaatggggataygtygggtggggayggaggtagtttttgttyggatagygaaattygygaggtttaggagagyggtagttagygyggtatagttygggagttgyggtttaygtyggagtttayggatatgggttyggaagggataaaaatygggtyggagttagygttggagtt

SEQ ID NO: 274 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 6: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 22: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 57: mod_base = OTHER; note = uracil
  modified_base 59: mod_base = OTHER; note = uracil
  modified_base 69: mod_base = OTHER; note = uracil
  modified_base 72: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 88: mod_base = OTHER; note = uracil
  modified_base 93: mod_base = OTHER; note = uracil
  modified_base 97: mod_base = OTHER; note = uracil
  modified_base 100: mod_base = OTHER; note = uracil
  modified_base 103: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 114: mod_base = OTHER; note = uracil
  modified_base 127: mod_base = OTHER; note = uracil
  modified_base 131: mod_base = OTHER; note = uracil
  modified_base 136: mod_base = OTHER; note = uracil
  modified_base 142: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 189: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 206: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 221: mod_base = OTHER; note = uracil
  modified_base 225: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 298: mod_base = OTHER; note = uracil
ggttttagygttgatttyggttyggtttttgtttttttygagtttatgttygtaggtttyggygtgggtygtagttttygggttgtgtygygttggttgtygtttttttgggtttygygggtttygttgttyggataggagttgttttygtttttattygaygtgtttttattgaggtttttgggygttyggyggtttygtygagtygagggttttttattttttygtttttttttayggyggtygtttagtttttttttttyggagaggttttttttttttaggygtttttygyggtyg

SEQ ID NO: 275 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 29: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 37: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 48: mod_base = OTHER; note = uracil
  modified_base 53: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 88: mod_base = OTHER; note = uracil
  modified_base 91: mod_base = OTHER; note = uracil
  modified_base 93: mod_base = OTHER; note = uracil
  modified_base 94: mod_base = OTHER; note = uracil
  modified_base 100: mod_base = OTHER; note = uracil
  modified_base 108: mod_base = OTHER; note = uracil
  modified_base 109: mod_base = OTHER; note = uracil
  modified_base 118: mod_base = OTHER; note = uracil
  modified_base 122: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 141: mod_base = OTHER; note = uracil
  modified_base 144: mod_base = OTHER; note = uracil
  modified_base 147: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 180: mod_base = OTHER; note = uracil
  modified_base 182: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 195: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 230: mod_base = OTHER; note = uracil
  modified_base 233: mod_base = OTHER; note = uracil
  modified_base 234: mod_base = OTHER; note = uracil
  modified_base 239: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 249: mod_base = OTHER; note = uracil
  modified_base 250: mod_base = OTHER; note = uracil
  modified_base 254: mod_base = OTHER; note = uracil
  modified_base 257: mod_base = OTHER; note = uracil
  modified_base 260: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 299: mod_base = OTHER; note = uracil
gtattatatatttttttttgtttttttgttgttaattagttttattattgtgtatttttgttttaattttattttttaygtttgttgttgtattttggatttgtttttttgaaattgtatgttatttatttttttttttatttttgttgygttttttttgttttattaggatttgtggatttaggattttygggtttttttttttatttttttttttygttgggttttattattattttagttatttttttggtagttttatttttgttttaagattttagtttttatttttttggtttt

SEQ ID NO: 276 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 20: mod_base = OTHER; note = uracil
  modified_base 27: mod_base = OTHER; note = uracil
  modified_base 34: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 60: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 107: mod_base = OTHER; note = uracil
  modified_base 108: mod_base = OTHER; note = uracil
  modified_base 116: mod_base = OTHER; note = uracil
  modified_base 117: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 141: mod_base = OTHER; note = uracil
  modified_base 152: mod_base = OTHER; note = uracil
  modified_base 155: mod_base = OTHER; note = uracil
  modified_base 180: mod_base = OTHER; note = uracil
  modified_base 184: mod_base = OTHER; note = uracil
  modified_base 190: mod_base = OTHER; note = uracil
  modified_base 198: mod_base = OTHER; note = uracil
  modified_base 203: mod_base = OTHER; note = uracil
  modified_base 204: mod_base = OTHER; note = uracil
  modified_base 211: mod_base = OTHER; note = uracil
  modified_base 214: mod_base = OTHER; note = uracil
  modified_base 217: mod_base = OTHER; note = uracil
  modified_base 241: mod_base = OTHER; note = uracil
  modified_base 249: mod_base = OTHER; note = uracil
  modified_base 251: mod_base = OTHER; note = uracil
  modified_base 262: mod_base = OTHER; note = uracil
  modified_base 270: mod_base = OTHER; note = uracil
  modified_base 273: mod_base = OTHER; note = uracil
  modified_base 281: mod_base = OTHER; note = uracil
  modified_base 300: mod_base = OTHER; note = uracil
agaattaggagggtggaggttggggttttggggtaggagtgaagttgttaggaaagtggttgaaatggtagtgaggtttaayggggaagagagatgggggagaaagttygggagttttgagtttataggttttgatagggtaagagggaygtagtagaagtagaagggagagtggatggtatgtaattttaggaaaataagtttaaggtgtagtagtaggygtgggaggtggaattggggtagaggtgtatagtggtggaattggttggtagtagggagatagggagggatgtgtgatgt

SEQ ID NO: 277 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 27: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 53: mod_base = OTHER; note = uracil
  modified_base 54: mod_base = OTHER; note = uracil
  modified_base 57: mod_base = OTHER; note = uracil
  modified_base 60: mod_base = OTHER; note = uracil
  modified_base 64: mod_base = OTHER; note = uracil
  modified_base 65: mod_base = OTHER; note = uracil
  modified_base 72: mod_base = OTHER; note = uracil
  modified_base 76: mod_base = OTHER; note = uracil
  modified_base 86: mod_base = OTHER; note = uracil
  modified_base 96: mod_base = OTHER; note = uracil
  modified_base 99: mod_base = OTHER; note = uracil
  modified_base 106: mod_base = OTHER; note = uracil
  modified_base 107: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 129: mod_base = OTHER; note = uracil
  modified_base 130: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 157: mod_base = OTHER; note = uracil
  modified_base 162: mod_base = OTHER; note = uracil
  modified_base 191: mod_base = OTHER; note = uracil
  modified_base 193: mod_base = OTHER; note = uracil
  modified_base 195: mod_base = OTHER; note = uracil
  modified_base 197: mod_base = OTHER; note = uracil
  modified_base 203: mod_base = OTHER; note = uracil
  modified_base 206: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 219: mod_base = OTHER; note = uracil
  modified_base 222: mod_base = OTHER; note = uracil
  modified_base 232: mod_base = OTHER; note = uracil
  modified_base 234: mod_base = OTHER; note = uracil
  modified_base 250: mod_base = OTHER; note = uracil
  modified_base 260: mod_base = OTHER; note = uracil
  modified_base 268: mod_base = OTHER; note = uracil
  modified_base 273: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 296: mod_base = OTHER; note = uracil
ggtggygatgttttagttatttgtttttttgtttttttttatataaatgtattttgtttttttttagatgttyggtttaatgggattggatttatttttaaaagttttggtttgtttttgattgaaaattagtgtgttttttatggttayggayggttgtgtaggtttttgttttgttgaagggaattggtttattttgagttagtygtgtattygggttgttgatgtagttttagtgtgatggttaaattttaagtgttaatttgattgggttaaggaatgttagatattattttyggg

SEQ ID NO: 278 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 15: mod_base = OTHER; note = uracil
  modified_base 19: mod_base = OTHER; note = uracil
  modified_base 23: mod_base = OTHER; note = uracil
  modified_base 24: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 35: mod_base = OTHER; note = uracil
  modified_base 43: mod_base = OTHER; note = uracil
  modified_base 45: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 65: mod_base = OTHER; note = uracil
  modified_base 71: mod_base = OTHER; note = uracil
  modified_base 74: mod_base = OTHER; note = uracil
  modified_base 77: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 91: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 111: mod_base = OTHER; note = uracil
  modified_base 112: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 125: mod_base = OTHER; note = uracil
  modified_base 130: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 142: mod_base = OTHER; note = uracil
  modified_base 145: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 177: mod_base = OTHER; note = uracil
  modified_base 181: mod_base = OTHER; note = uracil
  modified_base 187: mod_base = OTHER; note = uracil
  modified_base 191: mod_base = OTHER; note = uracil
  modified_base 192: mod_base = OTHER; note = uracil
  modified_base 197: mod_base = OTHER; note = uracil
  modified_base 212: mod_base = OTHER; note = uracil
  modified_base 213: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 226: mod_base = OTHER; note = uracil
  modified_base 231: mod_base = OTHER; note = uracil
  modified_base 234: mod_base = OTHER; note = uracil
  modified_base 245: mod_base = OTHER; note = uracil
  modified_base 252: mod_base = OTHER; note = uracil
  modified_base 270: mod_base = OTHER; note = uracil
  modified_base 278: mod_base = OTHER; note = uracil
  modified_base 285: mod_base = OTHER; note = uracil
  modified_base 291: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
ttyggaaataatgtttggtattttttagtttagttaaattgatatttaaagtttaattattatattgagattatattagtagttygggtgtayggttgatttagagtgagttaattttttttaataaaataaaaatttgtatagtygttygtaattatggggagtatattggtttttaattagaggtaaattaggatttttgaagataaatttagttttattaagtyggatatttggaaagaagtaggatatatttgtgtgaaagaggatagagaagtaggtggttagagtatygttatt

SEQ ID NO: 279 - DNA, 300 bp, synthetic construct
  misc_feature 1..300: note = Synthetic polynucleotide
  source 1..300: mol_type = other DNA
  modified_base 16: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 89: mod_base = OTHER; note = uracil
  modified_base 94: mod_base = OTHER; note = uracil
  modified_base 108: mod_base = OTHER; note = uracil
  modified_base 116: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 136: mod_base = OTHER; note = uracil
  modified_base 141: mod_base = OTHER; note = uracil
  modified_base 150: mod_base = OTHER; note = uracil
  modified_base 154: mod_base = OTHER; note = uracil
  modified_base 159: mod_base = OTHER; note = uracil
  modified_base 170: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 185: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 215: mod_base = OTHER; note = uracil
  modified_base 225: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 252: mod_base = OTHER; note = uracil
  modified_base 254: mod_base = OTHER; note = uracil
  modified_base 261: mod_base = OTHER; note = uracil
  modified_base 263: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 288: mod_base = OTHER; note = uracil
  modified_base 297: mod_base = OTHER; note = uracil
  modified_base 298: mod_base = OTHER; note = uracil
  modified_base 299: mod_base = OTHER; note = uracil
ggttttgggtgtggatattttggagggttgttttagtgtttatattaatgttttagttaaagaattattttgtttttttagttttttgtaggataggtgggaaagggtygggtgtttggttttgttgttaggggatagtgtaggtgtgatygttygggtagagatgagttattttttatattgttttgttgttygtttttaygtttagttttagttygtgtggttaagaaggggygattttttatttagaatatatgggttataaatgttatttttgaaaatggaaataaaaataattta

SEQ ID NO: 280 - DNA, 300 bp, synthetic construct
  misc_feature 1..300: note = Synthetic polynucleotide
  source 1..300: mol_type = other DNA
  modified_base 17: mod_base = OTHER; note = uracil
  modified_base 18: mod_base = OTHER; note = uracil
  modified_base 24: mod_base = OTHER; note = uracil
  modified_base 33: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 52: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 87: mod_base = OTHER; note = uracil
  modified_base 93: mod_base = OTHER; note = uracil
  modified_base 110: mod_base = OTHER; note = uracil
  modified_base 113: mod_base = OTHER; note = uracil
  modified_base 118: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 153: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 161: mod_base = OTHER; note = uracil
  modified_base 163: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 174: mod_base = OTHER; note = uracil
  modified_base 177: mod_base = OTHER; note = uracil
  modified_base 182: mod_base = OTHER; note = uracil
  modified_base 183: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 220: mod_base = OTHER; note = uracil
  modified_base 229: mod_base = OTHER; note = uracil
  modified_base 239: mod_base = OTHER; note = uracil
  modified_base 245: mod_base = OTHER; note = uracil
  modified_base 251: mod_base = OTHER; note = uracil
  modified_base 263: mod_base = OTHER; note = uracil
  modified_base 265: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 299: mod_base = OTHER; note = uracil
  modified_base 300: mod_base = OTHER; note = uracil
tgggttatttttgtttttatttttaaaggtagtatttgtgatttatgtgttttaggtgaggaatygtttttttttgattataygagttaaaattaggygtggagaygggtagtaagatagtgtggagggtgatttatttttgttyggayggttatatttgtattgttttttggtagtaggattagatattyggtttttttttatttgttttgtagaaggttaaggggatagggtggttttttaattagggtattggtgtgggtattaaaatagttttttaggatgtttatatttaaaatt

SEQ ID NO: 281 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 7: mod_base = OTHER; note = uracil
  modified_base 34: mod_base = OTHER; note = uracil
  modified_base 38: mod_base = OTHER; note = uracil
  modified_base 39: mod_base = OTHER; note = uracil
  modified_base 50: mod_base = OTHER; note = uracil
  modified_base 56: mod_base = OTHER; note = uracil
  modified_base 58: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 95: mod_base = OTHER; note = uracil
  modified_base 99: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 115: mod_base = OTHER; note = uracil
  modified_base 125: mod_base = OTHER; note = uracil
  modified_base 139: mod_base = OTHER; note = uracil
  modified_base 144: mod_base = OTHER; note = uracil
  modified_base 145: mod_base = OTHER; note = uracil
  modified_base 156: mod_base = OTHER; note = uracil
  modified_base 157: mod_base = OTHER; note = uracil
  modified_base 160: mod_base = OTHER; note = uracil
  modified_base 162: mod_base = OTHER; note = uracil
  modified_base 165: mod_base = OTHER; note = uracil
  modified_base 166: mod_base = OTHER; note = uracil
  modified_base 172: mod_base = OTHER; note = uracil
  modified_base 185: mod_base = OTHER; note = uracil
  modified_base 187: mod_base = OTHER; note = uracil
  modified_base 194: mod_base = OTHER; note = uracil
  modified_base 202: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 222: mod_base = OTHER; note = uracil
  modified_base 235: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 261: mod_base = OTHER; note = uracil
  modified_base 263: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 276: mod_base = OTHER; note = uracil
  modified_base 279: mod_base = OTHER; note = uracil
  modified_base 289: mod_base = OTHER; note = uracil
  modified_base 293: mod_base = OTHER; note = uracil
tagaatttgagygatgaagtgaygggatttagttaggtttatgaagagttaatggtatttgttttttataatttttttagttttattggttaattygtttgtttttygygtgatttttttggatttgaagtggtgttttaggattyggagygtggtttgtattgttttgttttgtttgtttgtgtatyggatttatygtgatttattttgagttatttaggtagtatggaagaattttggagttattttaaattttttggtttagaattttattttttttagaattaatatgtaagataa

SEQ ID NO: 282 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 19: mod_base = OTHER; note = uracil
  modified_base 36: mod_base = OTHER; note = uracil
  modified_base 41: mod_base = OTHER; note = uracil
  modified_base 42: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 89: mod_base = OTHER; note = uracil
  modified_base 91: mod_base = OTHER; note = uracil
  modified_base 101: mod_base = OTHER; note = uracil
  modified_base 111: mod_base = OTHER; note = uracil
  modified_base 117: mod_base = OTHER; note = uracil
  modified_base 119: mod_base = OTHER; note = uracil
  modified_base 123: mod_base = OTHER; note = uracil
  modified_base 127: mod_base = OTHER; note = uracil
  modified_base 132: mod_base = OTHER; note = uracil
  modified_base 137: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 153: mod_base = OTHER; note = uracil
  modified_base 159: mod_base = OTHER; note = uracil
  modified_base 160: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 174: mod_base = OTHER; note = uracil
  modified_base 179: mod_base = OTHER; note = uracil
  modified_base 180: mod_base = OTHER; note = uracil
  modified_base 189: mod_base = OTHER; note = uracil
  modified_base 200: mod_base = OTHER; note = uracil
  modified_base 212: mod_base = OTHER; note = uracil
  modified_base 213: mod_base = OTHER; note = uracil
  modified_base 221: mod_base = OTHER; note = uracil
  modified_base 240: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 255: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 269: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 282: mod_base = OTHER; note = uracil
  modified_base 285: mod_base = OTHER; note = uracil
  modified_base 290: mod_base = OTHER; note = uracil
  modified_base 292: mod_base = OTHER; note = uracil
  modified_base 298: mod_base = OTHER; note = uracil
ttattttgtatgttaattttagaagaaatggggttttgagttaaagggtttaaaataattttaaagtttttttatattgtttggatgatttaggatgagttaygatgaattyggtgtataaataaatagaataaggtagtgtaggttaygtttygggttttgaaatattattttagatttaaaaagattaygygagggatagaygggttggttaatgggattggaaggattatgggaggtaagtgttattgattttttataggtttgattaaatttygttattttatygtttaggttttg

SEQ ID NO: 283 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 10: mod_base = OTHER; note = uracil
  modified_base 12: mod_base = OTHER; note = uracil
  modified_base 13: mod_base = OTHER; note = uracil
  modified_base 18: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 49: mod_base = OTHER; note = uracil
  modified_base 50: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 74: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 120: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 136: mod_base = OTHER; note = uracil
  modified_base 145: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 159: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 181: mod_base = OTHER; note = uracil
  modified_base 186: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 197: mod_base = OTHER; note = uracil
  modified_base 206: mod_base = OTHER; note = uracil
  modified_base 208: mod_base = OTHER; note = uracil
  modified_base 213: mod_base = OTHER; note = uracil
  modified_base 215: mod_base = OTHER; note = uracil
  modified_base 217: mod_base = OTHER; note = uracil
  modified_base 220: mod_base = OTHER; note = uracil
  modified_base 222: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 242: mod_base = OTHER; note = uracil
  modified_base 247: mod_base = OTHER; note = uracil
  modified_base 249: mod_base = OTHER; note = uracil
  modified_base 252: mod_base = OTHER; note = uracil
  modified_base 255: mod_base = OTHER; note = uracil
  modified_base 258: mod_base = OTHER; note = uracil
  modified_base 273: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 290: mod_base = OTHER; note = uracil
gttttttggtattaggatattatttttttattttttttagatttttttttttgatttttttagagtagttatttttggagttgtttaaygttttttttttttttttttttgaattatagtttggtttatttattttygggttagtttaaygttttttttttttttttttttgaattatagtttggtttatttattttygggttagtttaaygtattttttttttttttttttgaattayggtttggtttatttatttttgggttaatttaggttttttttatagatagtttgaaaaggga

SEQ ID NO: 284 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 9: mod_base = OTHER; note = uracil
  modified_base 13: mod_base = OTHER; note = uracil
  modified_base 17: mod_base = OTHER; note = uracil
  modified_base 29: mod_base = OTHER; note = uracil
  modified_base 30: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 55: mod_base = OTHER; note = uracil
  modified_base 56: mod_base = OTHER; note = uracil
  modified_base 60: mod_base = OTHER; note = uracil
  modified_base 68: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 116: mod_base = OTHER; note = uracil
  modified_base 117: mod_base = OTHER; note = uracil
  modified_base 121: mod_base = OTHER; note = uracil
  modified_base 129: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 190: mod_base = OTHER; note = uracil
  modified_base 218: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 233: mod_base = OTHER; note = uracil
  modified_base 236: mod_base = OTHER; note = uracil
  modified_base 238: mod_base = OTHER; note = uracil
  modified_base 248: mod_base = OTHER; note = uracil
  modified_base 261: mod_base = OTHER; note = uracil
  modified_base 285: mod_base = OTHER; note = uracil
  modified_base 286: mod_base = OTHER; note = uracil
  modified_base 292: mod_base = OTHER; note = uracil
  modified_base 293: mod_base = OTHER; note = uracil
  modified_base 300: mod_base = OTHER; note = uracil
tttttttttagattatttgtggagaaagtttaaattaatttagaagtagatgagttaagtygtggtttagagggagaagagaagagtgygttgagttaattyggaagtagatgagttaagttgtggtttagagggagaaaagaagagggygttgagttaattyggaagtagatgagttaagttgtggtttagagggagaagagaagagggygttgagtaattttaaggatggttgttttaaagaggttaaggagaagggtttgggagaggtgggagggtgatgttttggtgttaagggat

SEQ ID NO: 285 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 10: mod_base = OTHER; note = uracil
  modified_base 15: mod_base = OTHER; note = uracil
  modified_base 19: mod_base = OTHER; note = uracil
  modified_base 24: mod_base = OTHER; note = uracil
  modified_base 31: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 47: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 74: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 91: mod_base = OTHER; note = uracil
  modified_base 97: mod_base = OTHER; note = uracil
  modified_base 98: mod_base = OTHER; note = uracil
  modified_base 110: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 127: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 150: mod_base = OTHER; note = uracil
  modified_base 153: mod_base = OTHER; note = uracil
  modified_base 154: mod_base = OTHER; note = uracil
  modified_base 167: mod_base = OTHER; note = uracil
  modified_base 184: mod_base = OTHER; note = uracil
  modified_base 190: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 219: mod_base = OTHER; note = uracil
  modified_base 221: mod_base = OTHER; note = uracil
  modified_base 229: mod_base = OTHER; note = uracil
  modified_base 233: mod_base = OTHER; note = uracil
  modified_base 243: mod_base = OTHER; note = uracil
  modified_base 245: mod_base = OTHER; note = uracil
  modified_base 251: mod_base = OTHER; note = uracil
  modified_base 255: mod_base = OTHER; note = uracil
  modified_base 265: mod_base = OTHER; note = uracil
  modified_base 295: mod_base = OTHER; note = uracil
ttgagttaataaggttgataaggttgtgttttggatgtaggttyggtagatgtttgagggggaggtggttagtttggaggtttttaggagtaygggtttggtgygggtgtygaggtttatgaaggttatygatttgtygggaggtggggtygtttttgtgatggagtatttgaagatgaagagtttgagtaggtgagtgtgtgtgagatttatatgygtatatgtgtataggtagagagagatttagagataaatagagagagatagagaaagggatagagatggggagggagatagaaa

SEQ ID NO: 286 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 8: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 52: mod_base = OTHER; note = uracil
  modified_base 54: mod_base = OTHER; note = uracil
  modified_base 60: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 75: mod_base = OTHER; note = uracil
  modified_base 77: mod_base = OTHER; note = uracil
  modified_base 85: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 100: mod_base = OTHER; note = uracil
  modified_base 102: mod_base = OTHER; note = uracil
  modified_base 104: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 114: mod_base = OTHER; note = uracil
  modified_base 118: mod_base = OTHER; note = uracil
  modified_base 120: mod_base = OTHER; note = uracil
  modified_base 123: mod_base = OTHER; note = uracil
  modified_base 126: mod_base = OTHER; note = uracil
  modified_base 129: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 143: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 165: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 249: mod_base = OTHER; note = uracil
  modified_base 252: mod_base = OTHER; note = uracil
  modified_base 255: mod_base = OTHER; note = uracil
  modified_base 260: mod_base = OTHER; note = uracil
  modified_base 261: mod_base = OTHER; note = uracil
  modified_base 264: mod_base = OTHER; note = uracil
  modified_base 267: mod_base = OTHER; note = uracil
  modified_base 268: mod_base = OTHER; note = uracil
  modified_base 273: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 296: mod_base = OTHER; note = uracil
  modified_base 298: mod_base = OTHER; note = uracil
tttttgtttttttttttatttttatttttttttttgtttttttttgtttgtttttgagtttttttttgtttgtatatatgtgygtatatgggttttatatatatttatttgtttaagttttttatttttaaatgttttattataaaggyggttttatttttyggtaggtygatgatttttatgggtttyggtattygtattaggttygtgtttttgagggtttttaggttggttattttttttttaaatatttgtygggtttgtatttagaatatagttttgttagttttgttgatttag

SEQ ID NO: 287 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 9: mod_base = OTHER; note = uracil
  modified_base 11: mod_base = OTHER; note = uracil
  modified_base 17: mod_base = OTHER; note = uracil
  modified_base 26: mod_base = OTHER; note = uracil
  modified_base 29: mod_base = OTHER; note = uracil
  modified_base 32: mod_base = OTHER; note = uracil
  modified_base 44: mod_base = OTHER; note = uracil
  modified_base 45: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 57: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 83: mod_base = OTHER; note = uracil
  modified_base 84: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 96: mod_base = OTHER; note = uracil
  modified_base 97: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 123: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 172: mod_base = OTHER; note = uracil
  modified_base 173: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 185: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 204: mod_base = OTHER; note = uracil
  modified_base 221: mod_base = OTHER; note = uracil
  modified_base 233: mod_base = OTHER; note = uracil
  modified_base 241: mod_base = OTHER; note = uracil
  modified_base 242: mod_base = OTHER; note = uracil
  modified_base 251: mod_base = OTHER; note = uracil
  modified_base 255: mod_base = OTHER; note = uracil
  modified_base 257: mod_base = OTHER; note = uracil
  modified_base 260: mod_base = OTHER; note = uracil
  modified_base 268: mod_base = OTHER; note = uracil
  modified_base 273: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 300: mod_base = OTHER; note = uracil
ttygtgtattttgyggtygyggyggtagtagtygyggyggyggttagtttttyggtttaygtgtttattattygygtgggttttatgttgttyggtttatygtattatttgtaggggtygggtagtgggttagttaattaygygggyggygygggygygtatttyggttggttttaggtttyggtygatagttttttatayggtagyggaggyggygyggttggyggyggggtygyggggtttggyggygttggtttagtygyggygtaygtttyggygygttttttttatttttttagt

SEQ ID NO: 288 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 24: mod_base = OTHER; note = uracil
  modified_base 36: mod_base = OTHER; note = uracil
  modified_base 42: mod_base = OTHER; note = uracil
  modified_base 47: mod_base = OTHER; note = uracil
  modified_base 48: mod_base = OTHER; note = uracil
  modified_base 53: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 81: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 95: mod_base = OTHER; note = uracil
  modified_base 98: mod_base = OTHER; note = uracil
  modified_base 110: mod_base = OTHER; note = uracil
  modified_base 117: mod_base = OTHER; note = uracil
  modified_base 123: mod_base = OTHER; note = uracil
  modified_base 124: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 168: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 206: mod_base = OTHER; note = uracil
  modified_base 211: mod_base = OTHER; note = uracil
  modified_base 214: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 238: mod_base = OTHER; note = uracil
  modified_base 246: mod_base = OTHER; note = uracil
  modified_base 254: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 270: mod_base = OTHER; note = uracil
  modified_base 273: mod_base = OTHER; note = uracil
  modified_base 276: mod_base = OTHER; note = uracil
  modified_base 279: mod_base = OTHER; note = uracil
  modified_base 285: mod_base = OTHER; note = uracil
  modified_base 288: mod_base = OTHER; note = uracil
  modified_base 295: mod_base = OTHER; note = uracil
gttgggagagtaggggaagygygtygagaygtgygtygyggttgagttagygtygttaggtttygyggtttygtygttagtygygtygttttygttgtygtatggagggttgtyggtygaggtttgaggttagtyggggtgygygttygygtygttygygtggttggttggtttattgttygatttttgtaggtggtayggtaggtygggtagtatggaatttaygygggtggtgggtaygtagatyggggagttggtygtygtygyggttgttgtygtygyggtygtagagtgtaygaa

SEQ ID NO: 289 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 14: mod_base = OTHER; note = uracil
  modified_base 19: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 36: mod_base = OTHER; note = uracil
  modified_base 38: mod_base = OTHER; note = uracil
  modified_base 80: mod_base = OTHER; note = uracil
  modified_base 82: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 102: mod_base = OTHER; note = uracil
  modified_base 108: mod_base = OTHER; note = uracil
  modified_base 114: mod_base = OTHER; note = uracil
  modified_base 119: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 138: mod_base = OTHER; note = uracil
  modified_base 139: mod_base = OTHER; note = uracil
  modified_base 146: mod_base = OTHER; note = uracil
  modified_base 155: mod_base = OTHER; note = uracil
  modified_base 158: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 179: mod_base = OTHER; note = uracil
  modified_base 188: mod_base = OTHER; note = uracil
  modified_base 192: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 234: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 263: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 300: mod_base = OTHER; note = uracil
tttttgtgtgagttatgttttatatttaataagtatttaaaaaaagattttttttttttttttttaagatggagtgtygttttgttatttaggttggagtgtagtggtatgattttggtttattgtaatttttgtttttygggtttaagygatttttttgttttaggtttttgagtagttggaattataggtatgttttattatattyggttaatttttatatgtaatagaaataaggttttattatgttggttagataggttttgaatttttgattttaggtgatttatttatttyggt

SEQ ID NO: 290 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 27: mod_base = OTHER; note = uracil
  modified_base 35: mod_base = OTHER; note = uracil
  modified_base 40: mod_base = OTHER; note = uracil
  modified_base 41: mod_base = OTHER; note = uracil
  modified_base 45: mod_base = OTHER; note = uracil
  modified_base 49: mod_base = OTHER; note = uracil
  modified_base 50: mod_base = OTHER; note = uracil
  modified_base 53: mod_base = OTHER; note = uracil
  modified_base 63: mod_base = OTHER; note = uracil
  modified_base 64: mod_base = OTHER; note = uracil
  modified_base 71: mod_base = OTHER; note = uracil
  modified_base 77: mod_base = OTHER; note = uracil
  modified_base 91: mod_base = OTHER; note = uracil
  modified_base 106: mod_base = OTHER; note = uracil
  modified_base 110: mod_base = OTHER; note = uracil
  modified_base 111: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 126: mod_base = OTHER; note = uracil
  modified_base 128: mod_base = OTHER; note = uracil
  modified_base 134: mod_base = OTHER; note = uracil
  modified_base 135: mod_base = OTHER; note = uracil
  modified_base 141: mod_base = OTHER; note = uracil
  modified_base 152: mod_base = OTHER; note = uracil
  modified_base 158: mod_base = OTHER; note = uracil
  modified_base 159: mod_base = OTHER; note = uracil
  modified_base 167: mod_base = OTHER; note = uracil
  modified_base 176: mod_base = OTHER; note = uracil
  modified_base 183: mod_base = OTHER; note = uracil
  modified_base 184: mod_base = OTHER; note = uracil
  modified_base 190: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 200: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 217: mod_base = OTHER; note = uracil
  modified_base 225: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 233: mod_base = OTHER; note = uracil
  modified_base 255: mod_base = OTHER; note = uracil
  modified_base 268: mod_base = OTHER; note = uracil
  modified_base 284: mod_base = OTHER; note = uracil
  modified_base 289: mod_base = OTHER; note = uracil
  modified_base 291: mod_base = OTHER; note = uracil
  modified_base 293: mod_base = OTHER; note = uracil
  modified_base 295: mod_base = OTHER; note = uracil
gtygaggtgggtggattatttgaggttaggagtttaagatttgtttggttaatatggtgaaattttgtttttattatatataaaaattagtygggtgtggtggggtatgtttgtaattttagttatttaggagtttgaggtagaagaatygtttgaattygggaggtagaggttgtagtgagttaagattatgttattgtattttagtttgggtgatagagygatattttattttaaaaaaaaaaaaaaaaaatttttttttgagtatttgttggatataagatatgatttatataaaga

SEQ ID NO: 291 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 59: mod_base = OTHER; note = uracil
  modified_base 67: mod_base = OTHER; note = uracil
  modified_base 73: mod_base = OTHER; note = uracil
  modified_base 79: mod_base = OTHER; note = uracil
  modified_base 86: mod_base = OTHER; note = uracil
  modified_base 97: mod_base = OTHER; note = uracil
  modified_base 98: mod_base = OTHER; note = uracil
  modified_base 106: mod_base = OTHER; note = uracil
  modified_base 118: mod_base = OTHER; note = uracil
  modified_base 119: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 131: mod_base = OTHER; note = uracil
  modified_base 132: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 173: mod_base = OTHER; note = uracil
  modified_base 176: mod_base = OTHER; note = uracil
  modified_base 179: mod_base = OTHER; note = uracil
  modified_base 188: mod_base = OTHER; note = uracil
  modified_base 189: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 206: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 263: mod_base = OTHER; note = uracil
  modified_base 268: mod_base = OTHER; note = uracil
  modified_base 269: mod_base = OTHER; note = uracil
  modified_base 290: mod_base = OTHER; note = uracil
  modified_base 291: mod_base = OTHER; note = uracil
attattttttgattttttatgatttatttagtttttaagtgtttttgggtatttagttttttgtggtatgggtyggtgtaagtttttatatgagagttagagagatagggagggaggttygggtttttggttttttgggaaaagatgttygttttagattagtaaaaggaggtagttgttttaggagttygggaaaatgttattattgatagtattattattatttttttattttttttttgtgtttttaaaatgaaaagtttagatttatggggtagggtagagtgggtttggagggag

SEQ ID NO: 292 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 6: mod_base = OTHER; note = uracil
  modified_base 7: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 35: mod_base = OTHER; note = uracil
  modified_base 40: mod_base = OTHER; note = uracil
  modified_base 45: mod_base = OTHER; note = uracil
  modified_base 56: mod_base = OTHER; note = uracil
  modified_base 58: mod_base = OTHER; note = uracil
  modified_base 88: mod_base = OTHER; note = uracil
  modified_base 92: mod_base = OTHER; note = uracil
  modified_base 101: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 122: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 138: mod_base = OTHER; note = uracil
  modified_base 143: mod_base = OTHER; note = uracil
  modified_base 153: mod_base = OTHER; note = uracil
  modified_base 156: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 177: mod_base = OTHER; note = uracil
  modified_base 178: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 206: mod_base = OTHER; note = uracil
  modified_base 208: mod_base = OTHER; note = uracil
  modified_base 218: mod_base = OTHER; note = uracil
  modified_base 222: mod_base = OTHER; note = uracil
  modified_base 224: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 244: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 259: mod_base = OTHER; note = uracil
  modified_base 261: mod_base = OTHER; note = uracil
  modified_base 269: mod_base = OTHER; note = uracil
  modified_base 279: mod_base = OTHER; note = uracil
  modified_base 289: mod_base = OTHER; note = uracil
tttttttaggtttattttattttattttatggatttgaattttttattttaaaaatataaagggaaaatgggaaaataataataatattattagtgatggtattttttygggtttttaaagtagttgtttttttttgttggtttgagaygggtatttttttttaaaaggttaggagttygggtttttttttttgtttttttggtttttatatagaaatttgtatyggtttatgttataaagaattgggtgtttaggggtatttaggagttgggtgagttatgaggggttagggggtggtt

SEQ ID NO: 293 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 28: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 38: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 64: mod_base = OTHER; note = uracil
  modified_base 65: mod_base = OTHER; note = uracil
  modified_base 93: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 115: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 132: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 153: mod_base = OTHER; note = uracil
  modified_base 155: mod_base = OTHER; note = uracil
  modified_base 159: mod_base = OTHER; note = uracil
  modified_base 166: mod_base = OTHER; note = uracil
  modified_base 171: mod_base = OTHER; note = uracil
  modified_base 172: mod_base = OTHER; note = uracil
  modified_base 178: mod_base = OTHER; note = uracil
  modified_base 180: mod_base = OTHER; note = uracil
  modified_base 188: mod_base = OTHER; note = uracil
  modified_base 189: mod_base = OTHER; note = uracil
  modified_base 196: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 221: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 259: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 294: mod_base = OTHER; note = uracil
  modified_base 296: mod_base = OTHER; note = uracil
  modified_base 299: mod_base = OTHER; note = uracil
  modified_base 300: mod_base = OTHER; note = uracil
gtagtaygtagtttttaggggttttaatttattttttttttttttatagggtttttttgtygtttagtgttgggtgagaaaggtggaggggatatgtagtttyggatggaggtgtagtattaaygagagagtttyggtttgtgggagggaygtttaggtttaggttaaagttaggagtttygggaaatttgggtttagtygttaygttttayggaggggatatatttttttttgtttgatggtagggtttatggtagataaaatttatgattttattttttttggttttagggtttagtt

SEQ ID NO: 294 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 16: mod_base = OTHER; note = uracil
  modified_base 17: mod_base = OTHER; note = uracil
  modified_base 32: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 67: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 103: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 117: mod_base = OTHER; note = uracil
  modified_base 118: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 143: mod_base = OTHER; note = uracil
  modified_base 144: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 164: mod_base = OTHER; note = uracil
  modified_base 170: mod_base = OTHER; note = uracil
  modified_base 172: mod_base = OTHER; note = uracil
  modified_base 174: mod_base = OTHER; note = uracil
  modified_base 184: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 202: mod_base = OTHER; note = uracil
  modified_base 205: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 234: mod_base = OTHER; note = uracil
  modified_base 242: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 290: mod_base = OTHER; note = uracil
  modified_base 297: mod_base = OTHER; note = uracil
  modified_base 300: mod_base = OTHER; note = uracil
ggttgagttttggagttaggagaggtgaggttatgggttttgtttattatgggttttgttattaggtagggaagggtgtgtttttttygtggggygtggyggttgaatttaggtttttyggagtttttggttttgatttaagtttgagygttttttttataggtyggagttttttygttggtgttgtatttttattyggggttatatgttttttttattttttttatttaatattggayggtagggaagttttgtgagggaagagggggtgagttagggtttttgggggttgygtgttgt

SEQ ID NO: 295 - DNA, 300 bp, synthetic construct; identical to SEQ ID NO: 294
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 17: mod_base = OTHER; note = uracil
  modified_base 30: mod_base = OTHER; note = uracil
  modified_base 33: mod_base = OTHER; note = uracil
  modified_base 49: mod_base = OTHER; note = uracil
  modified_base 56: mod_base = OTHER; note = uracil
  modified_base 60: mod_base = OTHER; note = uracil
  modified_base 61: mod_base = OTHER; note = uracil
  modified_base 64: mod_base = OTHER; note = uracil
  modified_base 66: mod_base = OTHER; note = uracil
  modified_base 80: mod_base = OTHER; note = uracil
  modified_base 84: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 102: mod_base = OTHER; note = uracil
  modified_base 105: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 134: mod_base = OTHER; note = uracil
  modified_base 155: mod_base = OTHER; note = uracil
  modified_base 156: mod_base = OTHER; note = uracil
  modified_base 163: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 196: mod_base = OTHER; note = uracil
  modified_base 201: mod_base = OTHER; note = uracil
  modified_base 202: mod_base = OTHER; note = uracil
  modified_base 205: mod_base = OTHER; note = uracil
  modified_base 210: mod_base = OTHER; note = uracil
  modified_base 212: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 230: mod_base = OTHER; note = uracil
  modified_base 233: mod_base = OTHER; note = uracil
  modified_base 236: mod_base = OTHER; note = uracil
  modified_base 261: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 283: mod_base = OTHER; note = uracil
  modified_base 294: mod_base = OTHER; note = uracil
  modified_base 299: mod_base = OTHER; note = uracil

SEQ ID NO: 296 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 18: mod_base = OTHER; note = uracil
  modified_base 22: mod_base = OTHER; note = uracil
  modified_base 26: mod_base = OTHER; note = uracil
  modified_base 35: mod_base = OTHER; note = uracil
  modified_base 42: mod_base = OTHER; note = uracil
  modified_base 46: mod_base = OTHER; note = uracil
  modified_base 47: mod_base = OTHER; note = uracil
  modified_base 52: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 65: mod_base = OTHER; note = uracil
  modified_base 68: mod_base = OTHER; note = uracil
  modified_base 76: mod_base = OTHER; note = uracil
  modified_base 81: mod_base = OTHER; note = uracil
  modified_base 93: mod_base = OTHER; note = uracil
  modified_base 96: mod_base = OTHER; note = uracil
  modified_base 101: mod_base = OTHER; note = uracil
  modified_base 107: mod_base = OTHER; note = uracil
  modified_base 110: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 175: mod_base = OTHER; note = uracil
  modified_base 180: mod_base = OTHER; note = uracil
  modified_base 181: mod_base = OTHER; note = uracil
  modified_base 186: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 196: mod_base = OTHER; note = uracil
  modified_base 202: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 227: mod_base = OTHER; note = uracil
  modified_base 229: mod_base = OTHER; note = uracil
  modified_base 232: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 256: mod_base = OTHER; note = uracil
  modified_base 259: mod_base = OTHER; note = uracil
  modified_base 265: mod_base = OTHER; note = uracil
  modified_base 274: mod_base = OTHER; note = uracil
  modified_base 276: mod_base = OTHER; note = uracil
  modified_base 279: mod_base = OTHER; note = uracil
  modified_base 285: mod_base = OTHER; note = uracil
gttatgtatttatatagtaaatatatagtggtgtttttgtttttatttatatttttttttaaagttgttgaaaaataaggttggaaagtgtttagttggattagygttgttggaaatttattttggtgatttttyggttttttggtttygttttttttttttttagttttaaagtagtgttygtatatatttttgttgatatygggggaatattagtaagttttaatataattgagaaggaatgygtttagttygttatttatattgatgatttattttaatgataggtagaaagaaatg

SEQ ID NO: 297 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 19: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 54: mod_base = OTHER; note = uracil
  modified_base 57: mod_base = OTHER; note = uracil
  modified_base 60: mod_base = OTHER; note = uracil
  modified_base 61: mod_base = OTHER; note = uracil
  modified_base 69: mod_base = OTHER; note = uracil
  modified_base 72: mod_base = OTHER; note = uracil
  modified_base 80: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 117: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 138: mod_base = OTHER; note = uracil
  modified_base 145: mod_base = OTHER; note = uracil
  modified_base 154: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 181: mod_base = OTHER; note = uracil
  modified_base 183: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 220: mod_base = OTHER; note = uracil
  modified_base 224: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 266: mod_base = OTHER; note = uracil
  modified_base 267: mod_base = OTHER; note = uracil
  modified_base 271: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 283: mod_base = OTHER; note = uracil
  modified_base 285: mod_base = OTHER; note = uracil
  modified_base 290: mod_base = OTHER; note = uracil
  modified_base 293: mod_base = OTHER; note = uracil
  modified_base 298: mod_base = OTHER; note = uracil
  modified_base 299: mod_base = OTHER; note = uracil
attggtttggttttttttttaatattttttattygggatgtagttaagagtggttgtagtttaattttttatatgtaaataatgattttagtgatgtttayggggtttttttttggttttttttttttgggaaaagattgagttttygaygggtatttttttttttttyggaattaagggttttgggatgttgatagttttygttatttttgagaagggtaggtygtggaaaattatttttttttttttttttttttttgttttttttagttggggtttttgtataatgtagttgggtta

SEQ ID NO: 298 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 9: mod_base = OTHER; note = uracil
  modified_base 12: mod_base = OTHER; note = uracil
  modified_base 19: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 31: mod_base = OTHER; note = uracil
  modified_base 41: mod_base = OTHER; note = uracil
  modified_base 72: mod_base = OTHER; note = uracil
  modified_base 73: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 89: mod_base = OTHER; note = uracil
  modified_base 104: mod_base = OTHER; note = uracil
  modified_base 108: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 130: mod_base = OTHER; note = uracil
  modified_base 148: mod_base = OTHER; note = uracil
  modified_base 149: mod_base = OTHER; note = uracil
  modified_base 159: mod_base = OTHER; note = uracil
  modified_base 161: mod_base = OTHER; note = uracil
  modified_base 165: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 185: mod_base = OTHER; note = uracil
  modified_base 186: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 205: mod_base = OTHER; note = uracil
  modified_base 208: mod_base = OTHER; note = uracil
  modified_base 210: mod_base = OTHER; note = uracil
  modified_base 217: mod_base = OTHER; note = uracil
  modified_base 226: mod_base = OTHER; note = uracil
  modified_base 242: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 253: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 291: mod_base = OTHER; note = uracil
  modified_base 292: mod_base = OTHER; note = uracil
  modified_base 296: mod_base = OTHER; note = uracil
  modified_base 297: mod_base = OTHER; note = uracil
tggtttagttgtattgtgtagaggttttagttaggaaaggtagagggggaaggaagggaggagatggttttttayggtttgttttttttagaggtggygggggttgttaatattttagagtttttggtttyggagggggaggggatgttygtygagaatttagtttttttttagggggagaaggttagagaggggtttygtgggtattattgaggttattgtttatatgtagaaaattaggttgtagttatttttggttgtatttygggtgggaggtgttagaaagaggattagattaat

SEQ ID NO: 299 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 11: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 60: mod_base = OTHER; note = uracil
  modified_base 62: mod_base = OTHER; note = uracil
  modified_base 64: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 79: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 122: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 170: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 186: mod_base = OTHER; note = uracil
  modified_base 199: mod_base = OTHER; note = uracil
  modified_base 200: mod_base = OTHER; note = uracil
  modified_base 202: mod_base = OTHER; note = uracil
  modified_base 205: mod_base = OTHER; note = uracil
  modified_base 206: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 234: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 250: mod_base = OTHER; note = uracil
  modified_base 258: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 297: mod_base = OTHER; note = uracil
ttgtttttatttttaggttttggaggagggtaggtgtttggttagtagagtggttattgtttattggtttagaggaagtaaggttattagtttgattttattttttttttyggtttatttttatttttttttttttaattataagtttygttaaaatagagattttyggttttgtttttttgttgtaggaagggagagttatygttagatattgtttgtttggtttttttgttttgattttattyggtgtttggaattaaagaggatttggtttttttttygggataygtgatttttttt

SEQ ID NO: 300 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 16: mod_base = OTHER; note = uracil
  modified_base 17: mod_base = OTHER; note = uracil
  modified_base 29: mod_base = OTHER; note = uracil
  modified_base 30: mod_base = OTHER; note = uracil
  modified_base 35: mod_base = OTHER; note = uracil
  modified_base 36: mod_base = OTHER; note = uracil
  modified_base 38: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 53: mod_base = OTHER; note = uracil
  modified_base 64: mod_base = OTHER; note = uracil
  modified_base 69: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 86: mod_base = OTHER; note = uracil
  modified_base 92: mod_base = OTHER; note = uracil
  modified_base 102: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 111: mod_base = OTHER; note = uracil
  modified_base 112: mod_base = OTHER; note = uracil
  modified_base 115: mod_base = OTHER; note = uracil
  modified_base 118: mod_base = OTHER; note = uracil
  modified_base 126: mod_base = OTHER; note = uracil
  modified_base 131: mod_base = OTHER; note = uracil
  modified_base 139: mod_base = OTHER; note = uracil
  modified_base 141: mod_base = OTHER; note = uracil
  modified_base 155: mod_base = OTHER; note = uracil
  modified_base 187: mod_base = OTHER; note = uracil
  modified_base 206: mod_base = OTHER; note = uracil
  modified_base 210: mod_base = OTHER; note = uracil
  modified_base 217: mod_base = OTHER; note = uracil
  modified_base 218: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 233: mod_base = OTHER; note = uracil
  modified_base 234: mod_base = OTHER; note = uracil
  modified_base 241: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 252: mod_base = OTHER; note = uracil
  modified_base 255: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 283: mod_base = OTHER; note = uracil
  modified_base 284: mod_base = OTHER; note = uracil
  modified_base 297: mod_base = OTHER; note = uracil
aagaaaattaygtatttygagagggaagttaggttttttttgattttaagtatygggtgagattagaataggaggattaggtaggtagtgtttggyggtggttttttttttttgtagtaggggagtaaagtygggggtttttattttggyggggtttgtggttgaggagaggggagtgaagatgggtyggagggagaagtgggattaggttggtggttttgttttttttgggttagtgagtagtggttattttgttggttaggtatttatttttttttaaagtttggagatgagggtaag

SEQ ID NO: 301 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 9: mod_base = OTHER; note = uracil
  modified_base 13: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 36: mod_base = OTHER; note = uracil
  modified_base 38: mod_base = OTHER; note = uracil
  modified_base 40: mod_base = OTHER; note = uracil
  modified_base 45: mod_base = OTHER; note = uracil
  modified_base 48: mod_base = OTHER; note = uracil
  modified_base 54: mod_base = OTHER; note = uracil
  modified_base 63: mod_base = OTHER; note = uracil
  modified_base 71: mod_base = OTHER; note = uracil
  modified_base 72: mod_base = OTHER; note = uracil
  modified_base 89: mod_base = OTHER; note = uracil
  modified_base 91: mod_base = OTHER; note = uracil
  modified_base 122: mod_base = OTHER; note = uracil
  modified_base 136: mod_base = OTHER; note = uracil
  modified_base 160: mod_base = OTHER; note = uracil
  modified_base 181: mod_base = OTHER; note = uracil
  modified_base 188: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 201: mod_base = OTHER; note = uracil
  modified_base 204: mod_base = OTHER; note = uracil
  modified_base 206: mod_base = OTHER; note = uracil
  modified_base 230: mod_base = OTHER; note = uracil
  modified_base 235: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 260: mod_base = OTHER; note = uracil
  modified_base 274: mod_base = OTHER; note = uracil
  modified_base 281: mod_base = OTHER; note = uracil
  modified_base 283: mod_base = OTHER; note = uracil
  modified_base 288: mod_base = OTHER; note = uracil
gtttagattaggtagyggggtygttttttttaggatttttaaggtagttaaggttggaggygtyggygagtttggagagggaggagtttattaaattgtgttggatggaaggygtygaggatyggaggaattaattygatgtggggaaggyggayggggttaygaggaaaaaagagggggtaatgtatatttagtttttttattattyggyggggagatggatggtttttyggatygggygttttagygtttyggttagttatagggagaygttagagygttttggttygygatagaaga

SEQ ID NO: 302 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 15: mod_base = OTHER; note = uracil
  modified_base 16: mod_base = OTHER; note = uracil
  modified_base 23: mod_base = OTHER; note = uracil
  modified_base 25: mod_base = OTHER; note = uracil
  modified_base 32: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 42: mod_base = OTHER; note = uracil
  modified_base 46: mod_base = OTHER; note = uracil
  modified_base 54: mod_base = OTHER; note = uracil
  modified_base 62: mod_base = OTHER; note = uracil
  modified_base 63: mod_base = OTHER; note = uracil
  modified_base 68: mod_base = OTHER; note = uracil
  modified_base 76: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 107: mod_base = OTHER; note = uracil
  modified_base 116: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 134: mod_base = OTHER; note = uracil
  modified_base 135: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 203: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 226: mod_base = OTHER; note = uracil
  modified_base 227: mod_base = OTHER; note = uracil
  modified_base 231: mod_base = OTHER; note = uracil
  modified_base 235: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 267: mod_base = OTHER; note = uracil
  modified_base 268: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 295: mod_base = OTHER; note = uracil
  modified_base 300: mod_base = OTHER; note = uracil
ttttttatygyggattagagygttttgaygtttttttatagttaatyggggygttgggaygttyggttyggaaaattatttattttttygtygagtgatgaaaaggttgagtgtatattgttttttttttttttttygtagtttygttygttttttttatatyggattaattttttyggttttygaygttttttatttaatataatttagtgaatttttttttttttaggttygtyggygtttttagttttagttgttttgagagttttggagagggygatttygttgtttgatttgggt

SEQ ID NO: 303 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 13: mod_base = OTHER; note = uracil
  modified_base 33: mod_base = OTHER; note = uracil
  modified_base 35: mod_base = OTHER; note = uracil
  modified_base 39: mod_base = OTHER; note = uracil
  modified_base 41: mod_base = OTHER; note = uracil
  modified_base 43: mod_base = OTHER; note = uracil
  modified_base 81: mod_base = OTHER; note = uracil
  modified_base 89: mod_base = OTHER; note = uracil
  modified_base 114: mod_base = OTHER; note = uracil
  modified_base 115: mod_base = OTHER; note = uracil
  modified_base 123: mod_base = OTHER; note = uracil
  modified_base 125: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 139: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 169: mod_base = OTHER; note = uracil
  modified_base 171: mod_base = OTHER; note = uracil
  modified_base 173: mod_base = OTHER; note = uracil
  modified_base 177: mod_base = OTHER; note = uracil
  modified_base 179: mod_base = OTHER; note = uracil
  modified_base 197: mod_base = OTHER; note = uracil
  modified_base 199: mod_base = OTHER; note = uracil
  modified_base 207: mod_base = OTHER; note = uracil
  modified_base 211: mod_base = OTHER; note = uracil
  modified_base 214: mod_base = OTHER; note = uracil
  modified_base 216: mod_base = OTHER; note = uracil
  modified_base 224: mod_base = OTHER; note = uracil
  modified_base 227: mod_base = OTHER; note = uracil
  modified_base 245: mod_base = OTHER; note = uracil
  modified_base 263: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 284: mod_base = OTHER; note = uracil
  modified_base 296: mod_base = OTHER; note = uracil
  modified_base 297: mod_base = OTHER; note = uracil
  modified_base 298: mod_base = OTHER; note = uracil
atttggtttgattttatttttaatattttttatattttttttttaaagaaaaaaaaggygagtgaatatygtgatgggtgtagttatgttgaataattggatgggaggaygtgttaggygatttttagtttttgggagtyggaygtttaygtttttttttgtttygtttttatagatatatttgtggggtgattaatttaggaatttatgttgtttaaagtaattatagtggtgagtgttttgatyggtttgatgtagaaattaaggaaaatattagaaaaattaggggyggaggtttaa

SEQ ID NO: 304 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 24: mod_base = OTHER; note = uracil
  modified_base 34: mod_base = OTHER; note = uracil
  modified_base 35: mod_base = OTHER; note = uracil
  modified_base 43: mod_base = OTHER; note = uracil
  modified_base 46: mod_base = OTHER; note = uracil
  modified_base 49: mod_base = OTHER; note = uracil
  modified_base 53: mod_base = OTHER; note = uracil
  modified_base 58: mod_base = OTHER; note = uracil
  modified_base 63: mod_base = OTHER; note = uracil
  modified_base 65: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 81: mod_base = OTHER; note = uracil
  modified_base 88: mod_base = OTHER; note = uracil
  modified_base 91: mod_base = OTHER; note = uracil
  modified_base 99: mod_base = OTHER; note = uracil
  modified_base 100: mod_base = OTHER; note = uracil
  modified_base 110: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 126: mod_base = OTHER; note = uracil
  modified_base 140: mod_base = OTHER; note = uracil
  modified_base 159: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 173: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 202: mod_base = OTHER; note = uracil
  modified_base 210: mod_base = OTHER; note = uracil
  modified_base 213: mod_base = OTHER; note = uracil
  modified_base 218: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 237: mod_base = OTHER; note = uracil
  modified_base 239: mod_base = OTHER; note = uracil
  modified_base 243: mod_base = OTHER; note = uracil
  modified_base 244: mod_base = OTHER; note = uracil
  modified_base 253: mod_base = OTHER; note = uracil
  modified_base 291: mod_base = OTHER; note = uracil
  modified_base 295: mod_base = OTHER; note = uracil
  modified_base 296: mod_base = OTHER; note = uracil
ttgggttttygtttttgatttttttggtgttttttttgatttttatattaaatyggttaaaatatttattattgtagttattttgagtagtatgaatttttgagttaattattttataaatgtgtttgtgagaaygaggtagagggaggygtgggygttyggtttttaggggttggagatygtttggtaygtttttttatttaattatttagtataattgtatttattaygatatttattygttttttttttttttagagagaaagtgtaaaaaatattaaaaataagattaagttaaat

SEQ ID NO: 305 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 10: mod_base = OTHER; note = uracil
  modified_base 15: mod_base = OTHER; note = uracil
  modified_base 17: mod_base = OTHER; note = uracil
  modified_base 19: mod_base = OTHER; note = uracil
  modified_base 28: mod_base = OTHER; note = uracil
  modified_base 43: mod_base = OTHER; note = uracil
  modified_base 46: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 84: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 108: mod_base = OTHER; note = uracil
  modified_base 111: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 135: mod_base = OTHER; note = uracil
  modified_base 139: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 154: mod_base = OTHER; note = uracil
  modified_base 156: mod_base = OTHER; note = uracil
  modified_base 157: mod_base = OTHER; note = uracil
  modified_base 161: mod_base = OTHER; note = uracil
  modified_base 165: mod_base = OTHER; note = uracil
  modified_base 168: mod_base = OTHER; note = uracil
  modified_base 171: mod_base = OTHER; note = uracil
  modified_base 178: mod_base = OTHER; note = uracil
  modified_base 180: mod_base = OTHER; note = uracil
  modified_base 187: mod_base = OTHER; note = uracil
  modified_base 190: mod_base = OTHER; note = uracil
  modified_base 192: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 208: mod_base = OTHER; note = uracil
  modified_base 212: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 270: mod_base = OTHER; note = uracil
  modified_base 282: mod_base = OTHER; note = uracil
  modified_base 295: mod_base = OTHER; note = uracil
  modified_base 300: mod_base = OTHER; note = uracil
tgatttttttattttttttaagatgattattaggagtggttttaataaaattgaatatagaattttgagggttttaattatgatttaattagagttttttttgaattttttatgagttagttyggttttttttattgattttattttagygggtatttgttttttttttttttttattattttttgttttttttttggtttttagttttgattgaatttagatttaatattttttaatttttttyggtttttttagggaaatttagaggtaaatttgagtgtagggagygggggtttygt

SEQ ID NO: 306 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 24: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 54: mod_base = OTHER; note = uracil
  modified_base 80: mod_base = OTHER; note = uracil
  modified_base 87: mod_base = OTHER; note = uracil
  modified_base 91: mod_base = OTHER; note = uracil
  modified_base 96: mod_base = OTHER; note = uracil
  modified_base 103: mod_base = OTHER; note = uracil
  modified_base 104: mod_base = OTHER; note = uracil
  modified_base 115: mod_base = OTHER; note = uracil
  modified_base 142: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 164: mod_base = OTHER; note = uracil
  modified_base 176: mod_base = OTHER; note = uracil
  modified_base 181: mod_base = OTHER; note = uracil
  modified_base 185: mod_base = OTHER; note = uracil
  modified_base 187: mod_base = OTHER; note = uracil
  modified_base 198: mod_base = OTHER; note = uracil
  modified_base 207: mod_base = OTHER; note = uracil
  modified_base 209: mod_base = OTHER; note = uracil
  modified_base 219: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 241: mod_base = OTHER; note = uracil
  modified_base 248: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 276: mod_base = OTHER; note = uracil
  modified_base 279: mod_base = OTHER; note = uracil
  modified_base 299: mod_base = OTHER; note = uracil
gygaagttttygttttttgtatttaaatttgtttttgggtttttttgagggggtygggaagaattggaaggtgttgggtttgaatttagttagagttggaaattaaaagagaagtaaaaagtgataaaagaagaagaaagataggtgttygttagggtgaagttagtggggagggtygggttgatttatgaagaatttagggagggttttggttgagttatgattggggtttttaaaattttgtgtttagttttgttgaaattatttttaatgattattttgagagaaatgaaaaagtta

SEQ ID NO: 307 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 57: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 104: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 119: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 138: mod_base = OTHER; note = uracil
  modified_base 141: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 180: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 198: mod_base = OTHER; note = uracil
  modified_base 201: mod_base = OTHER; note = uracil
  modified_base 207: mod_base = OTHER; note = uracil
  modified_base 208: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 258: mod_base = OTHER; note = uracil
  modified_base 265: mod_base = OTHER; note = uracil
  modified_base 267: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 288: mod_base = OTHER; note = uracil
  modified_base 292: mod_base = OTHER; note = uracil
ggtgttaggagtggtttaggagagtatttygtttttyggttygtaggtggtgtttgttggttttagtagggttaggaggttatttgtagtttggtgttttagattgatgttattygggtygagtgttgtgttttyggtaatattgatatygtttggtttaattttatttattyggggaataagattaattttttyggttttttgggttttgtttattgttttttttgtaaaggtgagattttaggttagaagtagggtagaygttttagtttaggattagttataaatagttatggtggt

SEQ ID NO: 308 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 11: mod_base = OTHER; note = uracil
  modified_base 21: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 74: mod_base = OTHER; note = uracil
  modified_base 83: mod_base = OTHER; note = uracil
  modified_base 90: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 104: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 145: mod_base = OTHER; note = uracil
  modified_base 146: mod_base = OTHER; note = uracil
  modified_base 156: mod_base = OTHER; note = uracil
  modified_base 164: mod_base = OTHER; note = uracil
  modified_base 171: mod_base = OTHER; note = uracil
  modified_base 173: mod_base = OTHER; note = uracil
  modified_base 176: mod_base = OTHER; note = uracil
  modified_base 178: mod_base = OTHER; note = uracil
  modified_base 183: mod_base = OTHER; note = uracil
  modified_base 184: mod_base = OTHER; note = uracil
  modified_base 192: mod_base = OTHER; note = uracil
  modified_base 195: mod_base = OTHER; note = uracil
  modified_base 199: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 215: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 241: mod_base = OTHER; note = uracil
  modified_base 242: mod_base = OTHER; note = uracil
  modified_base 245: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 262: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 297: mod_base = OTHER; note = uracil
  modified_base 299: mod_base = OTHER; note = uracil
  modified_base 300: mod_base = OTHER; note = uracil
attattatgattgtttgtggttggttttgagttgagaygtttgttttgtttttggtttgaggttttatttttgtagggaaggtagtggataaggtttaagaagtygaggaggttgattttgtttttygggtgggtgaggttggattaggyggtgttaatgttgtyggaggtatagtattyggttygggtgatattagtttggagtattaggttgtaggtggttttttggttttgttggagttagtaaatattatttgygggtyggggaayggggtgtttttttgggttatttttgatatt

SEQ ID NO: 309 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 19: mod_base = OTHER; note = uracil
  modified_base 26: mod_base = OTHER; note = uracil
  modified_base 28: mod_base = OTHER; note = uracil
  modified_base 30: mod_base = OTHER; note = uracil
  modified_base 33: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 55: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 76: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 88: mod_base = OTHER; note = uracil
  modified_base 89: mod_base = OTHER; note = uracil
  modified_base 91: mod_base = OTHER; note = uracil
  modified_base 98: mod_base = OTHER; note = uracil
  modified_base 105: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 130: mod_base = OTHER; note = uracil
  modified_base 131: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 147: mod_base = OTHER; note = uracil
  modified_base 153: mod_base = OTHER; note = uracil
  modified_base 155: mod_base = OTHER; note = uracil
  modified_base 164: mod_base = OTHER; note = uracil
  modified_base 167: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 224: mod_base = OTHER; note = uracil
  modified_base 225: mod_base = OTHER; note = uracil
  modified_base 233: mod_base = OTHER; note = uracil
  modified_base 241: mod_base = OTHER; note = uracil
  modified_base 247: mod_base = OTHER; note = uracil
  modified_base 248: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 260: mod_base = OTHER; note = uracil
  modified_base 263: mod_base = OTHER; note = uracil
  modified_base 272: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 296: mod_base = OTHER; note = uracil
  modified_base 297: mod_base = OTHER; note = uracil
  modified_base 300: mod_base = OTHER; note = uracil
gtagttttttttatttgtttggtgatttattataagttttgggggaaggaatggtagtggttttttttatttttattgtttttgyggttataatgggtagttgatataattatttgtaggtttygggagttatyggggttttttgataygtgtttattagtggtttttgaggagygtttgttttatttgttttaygtgtttttaygtttggttattttagggtttattagygttaatyggtaaatgtttgtgtttttatttatygggaaaatattttttttttttagagyggaggttagt

SEQ ID NO: 310 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 11: mod_base = OTHER; note = uracil
  modified_base 13: mod_base = OTHER; note = uracil
  modified_base 33: mod_base = OTHER; note = uracil
  modified_base 34: mod_base = OTHER; note = uracil
  modified_base 48: mod_base = OTHER; note = uracil
  modified_base 50: mod_base = OTHER; note = uracil
  modified_base 54: mod_base = OTHER; note = uracil
  modified_base 60: mod_base = OTHER; note = uracil
  modified_base 70: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 89: mod_base = OTHER; note = uracil
  modified_base 90: mod_base = OTHER; note = uracil
  modified_base 102: mod_base = OTHER; note = uracil
  modified_base 111: mod_base = OTHER; note = uracil
  modified_base 120: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 148: mod_base = OTHER; note = uracil
  modified_base 155: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 180: mod_base = OTHER; note = uracil
  modified_base 181: mod_base = OTHER; note = uracil
  modified_base 184: mod_base = OTHER; note = uracil
  modified_base 197: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 213: mod_base = OTHER; note = uracil
  modified_base 216: mod_base = OTHER; note = uracil
  modified_base 222: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 264: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 283: mod_base = OTHER; note = uracil
  modified_base 296: mod_base = OTHER; note = uracil
  modified_base 299: mod_base = OTHER; note = uracil
ttggttttygttttggagaagggagatgttttttyggtagatgagagtataggtatttgtygattagygttaatggattttggagtggttagaygtgggggtaygtggggtaggtggggtaggygttttttagaagttattaatgagtaygtgttaagaggtttygatggttttyggggtttgtaggtggttatgttaattgtttattgtggtygtagaggtagtaaaggtgaagagggttattgttatttttttttttagggtttgtagtgagttattaggtaggtgaagagggttgtt

SEQ ID NO: 311 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 20: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 42: mod_base = OTHER; note = uracil
  modified_base 49: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 97: mod_base = OTHER; note = uracil
  modified_base 99: mod_base = OTHER; note = uracil
  modified_base 108: mod_base = OTHER; note = uracil
  modified_base 111: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 168: mod_base = OTHER; note = uracil
  modified_base 169: mod_base = OTHER; note = uracil
  modified_base 177: mod_base = OTHER; note = uracil
  modified_base 185: mod_base = OTHER; note = uracil
  modified_base 191: mod_base = OTHER; note = uracil
  modified_base 192: mod_base = OTHER; note = uracil
  modified_base 197: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 207: mod_base = OTHER; note = uracil
  modified_base 216: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 252: mod_base = OTHER; note = uracil
  modified_base 253: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 282: mod_base = OTHER; note = uracil
  modified_base 283: mod_base = OTHER; note = uracil
  modified_base 290: mod_base = OTHER; note = uracil
  modified_base 295: mod_base = OTHER; note = uracil
  modified_base 300: mod_base = OTHER; note = uracil
gtggttttttttatttttattgtttttgyggttataatgggtagttgatataattatttgtaggtttygggagttatyggggttttttgataygtgtttattagtggtttttgaggagygtttgttttatttgttttaygtgtttttaygtttggttattttagggtttattagygttaatyggtaaatgtttgtgtttttatttatygggaaaatattttttttttttagagyggaggttagtttaaaaattaggttygtagttttygaggttttgaaaattaagyggttgttttggtt

SEQ ID NO: 312 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 8: mod_base = OTHER; note = uracil
  modified_base 11: mod_base = OTHER; note = uracil
  modified_base 14: mod_base = OTHER; note = uracil
  modified_base 23: mod_base = OTHER; note = uracil
  modified_base 28: mod_base = OTHER; note = uracil
  modified_base 29: mod_base = OTHER; note = uracil
  modified_base 37: mod_base = OTHER; note = uracil
  modified_base 44: mod_base = OTHER; note = uracil
  modified_base 45: mod_base = OTHER; note = uracil
  modified_base 57: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 67: mod_base = OTHER; note = uracil
  modified_base 69: mod_base = OTHER; note = uracil
  modified_base 89: mod_base = OTHER; note = uracil
  modified_base 90: mod_base = OTHER; note = uracil
  modified_base 104: mod_base = OTHER; note = uracil
  modified_base 106: mod_base = OTHER; note = uracil
  modified_base 110: mod_base = OTHER; note = uracil
  modified_base 116: mod_base = OTHER; note = uracil
  modified_base 126: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 145: mod_base = OTHER; note = uracil
  modified_base 146: mod_base = OTHER; note = uracil
  modified_base 158: mod_base = OTHER; note = uracil
  modified_base 167: mod_base = OTHER; note = uracil
  modified_base 176: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 204: mod_base = OTHER; note = uracil
  modified_base 211: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 236: mod_base = OTHER; note = uracil
  modified_base 237: mod_base = OTHER; note = uracil
  modified_base 240: mod_base = OTHER; note = uracil
  modified_base 253: mod_base = OTHER; note = uracil
  modified_base 256: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 269: mod_base = OTHER; note = uracil
  modified_base 272: mod_base = OTHER; note = uracil
  modified_base 278: mod_base = OTHER; note = uracil
  modified_base 296: mod_base = OTHER; note = uracil
  modified_base 297: mod_base = OTHER; note = uracil
  modified_base 299: mod_base = OTHER; note = uracil
attagaatagtygtttggtttttagagtttyggaggttgygggtttggtttttaggttggttttygttttggagaagggagatgttttttyggtagatgagagtataggtatttgtygattagygttaatggattttggagtggttagaygtgggggtaygtggggtaggtggggtaggygttttttagaagttattaatgagtaygtgttaagaggtttygatggttttyggggtttgtaggtggttatgttaattgtttattgtggtygtagaggtagtaaaggtgaagagggttatt

SEQ ID NO: 313 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 8: mod_base = OTHER; note = uracil
  modified_base 14: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 29: mod_base = OTHER; note = uracil
  modified_base 32: mod_base = OTHER; note = uracil
  modified_base 38: mod_base = OTHER; note = uracil
  modified_base 41: mod_base = OTHER; note = uracil
  modified_base 44: mod_base = OTHER; note = uracil
  modified_base 49: mod_base = OTHER; note = uracil
  modified_base 54: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 67: mod_base = OTHER; note = uracil
  modified_base 69: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 79: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 91: mod_base = OTHER; note = uracil
  modified_base 93: mod_base = OTHER; note = uracil
  modified_base 99: mod_base = OTHER; note = uracil
  modified_base 103: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 174: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 186: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 200: mod_base = OTHER; note = uracil
  modified_base 210: mod_base = OTHER; note = uracil
  modified_base 212: mod_base = OTHER; note = uracil
  modified_base 215: mod_base = OTHER; note = uracil
  modified_base 220: mod_base = OTHER; note = uracil
  modified_base 221: mod_base = OTHER; note = uracil
  modified_base 226: mod_base = OTHER; note = uracil
  modified_base 237: mod_base = OTHER; note = uracil
  modified_base 238: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 292: mod_base = OTHER; note = uracil
  modified_base 294: mod_base = OTHER; note = uracil
  modified_base 296: mod_base = OTHER; note = uracil
  modified_base 298: mod_base = OTHER; note = uracil
  modified_base 299: mod_base = OTHER; note = uracil
  modified_base 300: mod_base = OTHER; note = uracil
atgggttttggggtygtygttttagtgttttttggtgttgtagtygggtagggtygaattttggygtatagttttttgttgagtttttttttttaaggttgtttgtgggyggttttgtyggttttttttgtatttgtttaggttttgggyggaggttttttttttygggggggttgtggttttagtatagattaggggatagaaggtggttttttttggttttggttgggtgtgaattaaagattttttgtaagaaatttttttttttttttttttttttygtttttttatttttttttt

SEQ ID NO: 314 - DNA, 300 bp, synthetic construct
  misc_feature 1..300: note = Synthetic polynucleotide
  source 1..300: mol_type = other DNA
  modified_base 47: mod_base = OTHER; note = uracil
  modified_base 51: mod_base = OTHER; note = uracil
  modified_base 59: mod_base = OTHER; note = uracil
  modified_base 67: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 82: mod_base = OTHER; note = uracil
  modified_base 83: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 111: mod_base = OTHER; note = uracil
  modified_base 116: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 171: mod_base = OTHER; note = uracil
  modified_base 180: mod_base = OTHER; note = uracil
  modified_base 184: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 218: mod_base = OTHER; note = uracil
  modified_base 220: mod_base = OTHER; note = uracil
  modified_base 223: mod_base = OTHER; note = uracil
  modified_base 230: mod_base = OTHER; note = uracil
  modified_base 237: mod_base = OTHER; note = uracil
  modified_base 238: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 274: mod_base = OTHER; note = uracil
  modified_base 276: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 297: mod_base = OTHER; note = uracil
  modified_base 298: mod_base = OTHER; note = uracil
gggagagagatgagggagygaaggagggagagggagagggggattttttataggaagtttttggtttatatttagttaaggttaagaagagttattttttgttttttggtttgtgttgaggttatagttttttygggaggaggagttttygtttagggtttgggtaggtgtaggaggggtyggtagagtygtttatagatagttttagagagggagatttagtaggaagttgtgygttagggttyggttttgttyggttgtagtattagaagatattgaggyggyggttttagggtttat

SEQ ID NO: 315 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 8: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 17: mod_base = OTHER; note = uracil
  modified_base 20: mod_base = OTHER; note = uracil
  modified_base 31: mod_base = OTHER; note = uracil
  modified_base 46: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 61: mod_base = OTHER; note = uracil
  modified_base 66: mod_base = OTHER; note = uracil
  modified_base 73: mod_base = OTHER; note = uracil
  modified_base 78: mod_base = OTHER; note = uracil
  modified_base 89: mod_base = OTHER; note = uracil
  modified_base 92: mod_base = OTHER; note = uracil
  modified_base 95: mod_base = OTHER; note = uracil
  modified_base 100: mod_base = OTHER; note = uracil
  modified_base 103: mod_base = OTHER; note = uracil
  modified_base 107: mod_base = OTHER; note = uracil
  modified_base 114: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 131: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 172: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 209: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 227: mod_base = OTHER; note = uracil
  modified_base 241: mod_base = OTHER; note = uracil
  modified_base 247: mod_base = OTHER; note = uracil
  modified_base 253: mod_base = OTHER; note = uracil
  modified_base 258: mod_base = OTHER; note = uracil
  modified_base 264: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 287: mod_base = OTHER; note = uracil
tattggattatttatataatttttgaggattagtggaaatgaaaatayggtgtttyggtataaaatatattttatagtttgggttaggtaatagtaaagtattaygttgagygtygggattttttgagtgtaggyggtgggygaagtttygagttatatatatttaygaygtyggttttgtttttatagyggttttttggggtagygattggtattatttgtattttaygagggaggaaattgaggtaygaattgtttagaagttgttttgaggttattaagtgagttaggaagaggygt

SEQ ID NO: 316 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 14: mod_base = OTHER; note = uracil
  modified_base 16: mod_base = OTHER; note = uracil
  modified_base 18: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 34: mod_base = OTHER; note = uracil
  modified_base 37: mod_base = OTHER; note = uracil
  modified_base 40: mod_base = OTHER; note = uracil
  modified_base 45: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 79: mod_base = OTHER; note = uracil
  modified_base 88: mod_base = OTHER; note = uracil
  modified_base 89: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 108: mod_base = OTHER; note = uracil
  modified_base 111: mod_base = OTHER; note = uracil
  modified_base 120: mod_base = OTHER; note = uracil
  modified_base 125: mod_base = OTHER; note = uracil
  modified_base 147: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 170: mod_base = OTHER; note = uracil
  modified_base 172: mod_base = OTHER; note = uracil
  modified_base 174: mod_base = OTHER; note = uracil
  modified_base 182: mod_base = OTHER; note = uracil
  modified_base 183: mod_base = OTHER; note = uracil
  modified_base 189: mod_base = OTHER; note = uracil
  modified_base 191: mod_base = OTHER; note = uracil
  modified_base 201: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 242: mod_base = OTHER; note = uracil
  modified_base 248: mod_base = OTHER; note = uracil
  modified_base 250: mod_base = OTHER; note = uracil
  modified_base 259: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 294: mod_base = OTHER; note = uracil
  modified_base 295: mod_base = OTHER; note = uracil
ygtttttttttagtttatttggtgattttagggtagtttttgaatagttygtgttttagttttttttttygtgaaatgtaggtaatattagtygttattttagagggtygttgtgggagtagggtyggygtygtgggtgtgtgtgattyggggtttygtttatygtttgtatttagaaggtttyggygtttagygtgatgttttgttgttgtttaatttaagttatgaaatatgttttgtgtyggggtatygtgtttttatttttattgatttttaaaagttgtgtggatggtttagtgt

SEQ ID NO: 317 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 26: mod_base = OTHER; note = uracil
  modified_base 40: mod_base = OTHER; note = uracil
  modified_base 41: mod_base = OTHER; note = uracil
  modified_base 45: mod_base = OTHER; note = uracil
  modified_base 46: mod_base = OTHER; note = uracil
  modified_base 51: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 66: mod_base = OTHER; note = uracil
  modified_base 74: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 104: mod_base = OTHER; note = uracil
  modified_base 110: mod_base = OTHER; note = uracil
  modified_base 112: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 148: mod_base = OTHER; note = uracil
  modified_base 159: mod_base = OTHER; note = uracil
  modified_base 167: mod_base = OTHER; note = uracil
  modified_base 171: mod_base = OTHER; note = uracil
  modified_base 172: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 189: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 203: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 229: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 256: mod_base = OTHER; note = uracil
  modified_base 264: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 290: mod_base = OTHER; note = uracil
  modified_base 298: mod_base = OTHER; note = uracil
  modified_base 299: mod_base = OTHER; note = uracil
ttttagtgtgttttagttggtttatttgtaaaaatggggttaggttaygattggtgttttttttatagagaagtattttaggtaggggtgggtgggggtggaattygtttttaatggttttygggatagttttgtagttatyggtgattygggttygtttgyggatttttttyggtttttattttatttagggatagttttgtaatggggtttttttttaaaaaaaygtatggtttttttgttttttaaaattagtttaayggtagttattttttttttttttygggggttgaaaaatta

SEQ ID NO: 318 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 34: mod_base = OTHER; note = uracil
  modified_base 37: mod_base = OTHER; note = uracil
  modified_base 45: mod_base = OTHER; note = uracil
  modified_base 59: mod_base = OTHER; note = uracil
  modified_base 67: mod_base = OTHER; note = uracil
  modified_base 68: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 98: mod_base = OTHER; note = uracil
  modified_base 103: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 125: mod_base = OTHER; note = uracil
  modified_base 136: mod_base = OTHER; note = uracil
  modified_base 139: mod_base = OTHER; note = uracil
  modified_base 147: mod_base = OTHER; note = uracil
  modified_base 148: mod_base = OTHER; note = uracil
  modified_base 154: mod_base = OTHER; note = uracil
  modified_base 156: mod_base = OTHER; note = uracil
  modified_base 163: mod_base = OTHER; note = uracil
  modified_base 166: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 183: mod_base = OTHER; note = uracil
  modified_base 184: mod_base = OTHER; note = uracil
  modified_base 199: mod_base = OTHER; note = uracil
  modified_base 200: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 227: mod_base = OTHER; note = uracil
  modified_base 230: mod_base = OTHER; note = uracil
  modified_base 232: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 256: mod_base = OTHER; note = uracil
  modified_base 257: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 272: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 290: mod_base = OTHER; note = uracil
  modified_base 292: mod_base = OTHER; note = uracil
  modified_base 294: mod_base = OTHER; note = uracil
ggttttttagttttyggaggagggagggaatggttgtygttaagttggttttgggggataggaaggttatgygtttttttgggagggagttttattgtagggttgtttttgaatggagtggaggtygggaaagattygtagaygaattygagttatyggtggttgtagggttgtttygggggttattgagaaygagttttatttttatttatttttgtttggagtgtttttttgtaaagggaatattagtygtggtttggttttatttttatagataaattaattgaggtatattggagg

SEQ ID NO: 319 - DNA, 301 bp, synthetic construct
  misc_feature 1..301: note = Synthetic polynucleotide
  source 1..301: mol_type = other DNA
  modified_base 1: mod_base = OTHER; note = uracil
  modified_base 3: mod_base = OTHER; note = uracil
  modified_base 5: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 38: mod_base = OTHER; note = uracil
  modified_base 40: mod_base = OTHER; note = uracil
  modified_base 42: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 59: mod_base = OTHER; note = uracil
  modified_base 60: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 77: mod_base = OTHER; note = uracil
  modified_base 79: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 97: mod_base = OTHER; note = uracil
  modified_base 102: mod_base = OTHER; note = uracil
  modified_base 112: mod_base = OTHER; note = uracil
  modified_base 113: mod_base = OTHER; note = uracil
  modified_base 119: mod_base = OTHER; note = uracil
  modified_base 120: mod_base = OTHER; note = uracil
  modified_base 130: mod_base = OTHER; note = uracil
  modified_base 139: mod_base = OTHER; note = uracil
  modified_base 142: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 174: mod_base = OTHER; note = uracil
  modified_base 176: mod_base = OTHER; note = uracil
  modified_base 183: mod_base = OTHER; note = uracil
  modified_base 201: mod_base = OTHER; note = uracil
  modified_base 202: mod_base = OTHER; note = uracil
  modified_base 212: mod_base = OTHER; note = uracil
  modified_base 213: mod_base = OTHER; note = uracil
  modified_base 218: mod_base = OTHER; note = uracil
  modified_base 224: mod_base = OTHER; note = uracil
  modified_base 230: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 252: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 266: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 300: mod_base = OTHER; note = uracil
tatttaygggttagtttygttaggtgttgayggatgttatttaggtgtgagttttgtatttgagtttttttttgtatataggtagttataattagttagtgtagaggtgagtttgtggttagtgaggagtyggtgagttaattttttttygtttaygggttttgagaygtyggtttygtgagtttgyggggtygagggygtttatattaagttaaggttgaggtagtgatatatttttttatgggtttgttttygttttttgttttattgttttggtttttttttttygtatggaggatta

SEQ ID NO: 320 - DNA, 301 bp, synthetic construct
  misc_feature 1..301: note = Synthetic polynucleotide
  source 1..301: mol_type = other DNA
  modified_base 5: mod_base = OTHER; note = uracil
  modified_base 6: mod_base = OTHER; note = uracil
  modified_base 8: mod_base = OTHER; note = uracil
  modified_base 9: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 40: mod_base = OTHER; note = uracil
  modified_base 53: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 74: mod_base = OTHER; note = uracil
  modified_base 76: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 91: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 120: mod_base = OTHER; note = uracil
  modified_base 122: mod_base = OTHER; note = uracil
  modified_base 129: mod_base = OTHER; note = uracil
  modified_base 136: mod_base = OTHER; note = uracil
  modified_base 138: mod_base = OTHER; note = uracil
  modified_base 143: mod_base = OTHER; note = uracil
  modified_base 144: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 173: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 180: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 191: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 201: mod_base = OTHER; note = uracil
  modified_base 203: mod_base = OTHER; note = uracil
  modified_base 207: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 228: mod_base = OTHER; note = uracil
  modified_base 238: mod_base = OTHER; note = uracil
  modified_base 240: mod_base = OTHER; note = uracil
  modified_base 246: mod_base = OTHER; note = uracil
  modified_base 251: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 266: mod_base = OTHER; note = uracil
  modified_base 269: mod_base = OTHER; note = uracil
  modified_base 273: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 288: mod_base = OTHER; note = uracil
  modified_base 292: mod_base = OTHER; note = uracil
  modified_base 293: mod_base = OTHER; note = uracil
tgattttttataygagagggagagattaggataatgaagtagggagygagagtaggtttataagagggtgtgttattgttttagttttggtttaatataggygttttygatttygtaagtttayggagtyggygttttagggttygtaggygggaggaggttgatttatyggttttttattggttataggtttatttttgtattgattggttgtggttgtttgtgtgtaggggggagtttaggtgtagagtttatatttgagtgatattygttaatatttgayggagttagttygtgagtg

SEQ ID NO: 321 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 36: mod_base = OTHER; note = uracil
  modified_base 44: mod_base = OTHER; note = uracil
  modified_base 48: mod_base = OTHER; note = uracil
  modified_base 49: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 76: mod_base = OTHER; note = uracil
  modified_base 77: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 102: mod_base = OTHER; note = uracil
  modified_base 112: mod_base = OTHER; note = uracil
  modified_base 133: mod_base = OTHER; note = uracil
  modified_base 140: mod_base = OTHER; note = uracil
  modified_base 141: mod_base = OTHER; note = uracil
  modified_base 147: mod_base = OTHER; note = uracil
  modified_base 149: mod_base = OTHER; note = uracil
  modified_base 150: mod_base = OTHER; note = uracil
  modified_base 159: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 188: mod_base = OTHER; note = uracil
  modified_base 190: mod_base = OTHER; note = uracil
  modified_base 198: mod_base = OTHER; note = uracil
  modified_base 208: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 283: mod_base = OTHER; note = uracil
  modified_base 290: mod_base = OTHER; note = uracil
  modified_base 292: mod_base = OTHER; note = uracil
ttaggttgtttgggttttggtttttattatgttagtttggtgttygatttgtgttgagattttttttgtttttggttygggtgttttatttaagtaatggataggttggaataggygttygtagggaaygggttgaaygttygyggttttygygatgtttygygatattatttttttygttttygtttatttaaggatyggaagtagtaaagttygtygtygygtttttygtttygygtttttttggtaattagtttttttttttttttygtttataaggagtaagyggtataaatyggg

SEQ ID NO: 322 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 12: mod_base = OTHER; note = uracil
  modified_base 15: mod_base = OTHER; note = uracil
  modified_base 19: mod_base = OTHER; note = uracil
  modified_base 21: mod_base = OTHER; note = uracil
  modified_base 22: mod_base = OTHER; note = uracil
  modified_base 47: mod_base = OTHER; note = uracil
  modified_base 54: mod_base = OTHER; note = uracil
  modified_base 55: mod_base = OTHER; note = uracil
  modified_base 89: mod_base = OTHER; note = uracil
  modified_base 94: mod_base = OTHER; note = uracil
  modified_base 97: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 144: mod_base = OTHER; note = uracil
  modified_base 155: mod_base = OTHER; note = uracil
  modified_base 166: mod_base = OTHER; note = uracil
  modified_base 169: mod_base = OTHER; note = uracil
  modified_base 170: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 207: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 226: mod_base = OTHER; note = uracil
  modified_base 227: mod_base = OTHER; note = uracil
  modified_base 233: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 250: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 266: mod_base = OTHER; note = uracil
  modified_base 270: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 296: mod_base = OTHER; note = uracil
  modified_base 297: mod_base = OTHER; note = uracil
ttygatttgtgtygtttgttttttatgggygagggaaggggagaggttggttattagggagaygyggggyggggggygygayggygggttttgttattttyggtttttaagtgagygggggygagggaggtagtatygygagatatygygggagtygygggygtttagttygttttttaygaaygtttgttttaatttgtttattgtttggatgggatattygggttagaggtagggagggttttaatataggtyggatattaagttagtatggtggagattaaaatttaggtagtttgg

SEQ ID NO: 323 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 14: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 35: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 63: mod_base = OTHER; note = uracil
  modified_base 75: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 128: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 146: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 183: mod_base = OTHER; note = uracil
  modified_base 191: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 204: mod_base = OTHER; note = uracil
  modified_base 205: mod_base = OTHER; note = uracil
  modified_base 209: mod_base = OTHER; note = uracil
  modified_base 210: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 233: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 258: mod_base = OTHER; note = uracil
  modified_base 260: mod_base = OTHER; note = uracil
  modified_base 267: mod_base = OTHER; note = uracil
  modified_base 269: mod_base = OTHER; note = uracil
  modified_base 271: mod_base = OTHER; note = uracil
  modified_base 275: mod_base = OTHER; note = uracil
  modified_base 280: mod_base = OTHER; note = uracil
  modified_base 284: mod_base = OTHER; note = uracil
  modified_base 285: mod_base = OTHER; note = uracil
  modified_base 287: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 298: mod_base = OTHER; note = uracil
  modified_base 300: mod_base = OTHER; note = uracil
taatggtttttttttttagtttyggtgggygtggttgggggaattttagggygggyggggggtagggggtggtgttgagttatttagtttggttaggtttttgtttgttagttttttgtttttatygttatagttygtttyggatttaygaggtttagttagttatttttggatttttgagatygaattgtaaattgttygggtttggttttgaatttttgttgtttagggattaagttttgtggtttttaggggggtatagtgattttttaagttgagttggttttagggtttttgtat

SEQ ID NO: 324 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 17: mod_base = OTHER; note = uracil
  modified_base 18: mod_base = OTHER; note = uracil
  modified_base 21: mod_base = OTHER; note = uracil
  modified_base 23: mod_base = OTHER; note = uracil
  modified_base 26: mod_base = OTHER; note = uracil
  modified_base 36: mod_base = OTHER; note = uracil
  modified_base 38: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 76: mod_base = OTHER; note = uracil
  modified_base 79: mod_base = OTHER; note = uracil
  modified_base 87: mod_base = OTHER; note = uracil
  modified_base 92: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 103: mod_base = OTHER; note = uracil
  modified_base 110: mod_base = OTHER; note = uracil
  modified_base 119: mod_base = OTHER; note = uracil
  modified_base 121: mod_base = OTHER; note = uracil
  modified_base 128: mod_base = OTHER; note = uracil
  modified_base 129: mod_base = OTHER; note = uracil
  modified_base 138: mod_base = OTHER; note = uracil
  modified_base 142: mod_base = OTHER; note = uracil
  modified_base 147: mod_base = OTHER; note = uracil
  modified_base 148: mod_base = OTHER; note = uracil
  modified_base 157: mod_base = OTHER; note = uracil
  modified_base 167: mod_base = OTHER; note = uracil
  modified_base 182: mod_base = OTHER; note = uracil
  modified_base 189: mod_base = OTHER; note = uracil
  modified_base 193: mod_base = OTHER; note = uracil
  modified_base 197: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 221: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 281: mod_base = OTHER; note = uracil
  modified_base 294: mod_base = OTHER; note = uracil
  modified_base 295: mod_base = OTHER; note = uracil
tgtagaggttttgaggttagtttagtttgagagattattgtgtttttttgggagttataggatttggtttttaaatagtaggagtttaaggttaggttygggtagtttgtaattyggttttaggagtttagaggtggttggttgggtttygtagattyggggygggttgtagyggtgggggtagggggttggtaggtagggatttggttaggttgggtgatttagtattattttttgtttttygttygttttggggtttttttagttaygtttatygaggttgaagaaagaggttattgt

SEQ ID NO: 325 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 9: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 21: mod_base = OTHER; note = uracil
  modified_base 22: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 71: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 122: mod_base = OTHER; note = uracil
  modified_base 125: mod_base = OTHER; note = uracil
  modified_base 135: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 148: mod_base = OTHER; note = uracil
  modified_base 151: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 175: mod_base = OTHER; note = uracil
  modified_base 176: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 212: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 254: mod_base = OTHER; note = uracil
  modified_base 256: mod_base = OTHER; note = uracil
  modified_base 259: mod_base = OTHER; note = uracil
  modified_base 263: mod_base = OTHER; note = uracil
  modified_base 264: mod_base = OTHER; note = uracil
  modified_base 274: mod_base = OTHER; note = uracil
  modified_base 278: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 295: mod_base = OTHER; note = uracil
  modified_base 299: mod_base = OTHER; note = uracil
  modified_base 300: mod_base = OTHER; note = uracil
attttgtgtagggtttgtatttyggaaggtttttattagttygaatttggttygttygttttagatggggtaatyggygtttttttygggatagttttttttttggttttttggttttygtttgtattgagaggtttggtttttggttygtatgttgtttttttygtgttgtggttttgtagttyggttttttttttgttgttttttttggttttggtttggtttttgggtttttgagttatttttgaggtgatttagtagtttttggaaaygtatgtygaggaygtattttgtttggtt

SEQ ID NO: 326 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 7: mod_base = OTHER; note = uracil
  modified_base 17: mod_base = OTHER; note = uracil
  modified_base 18: mod_base = OTHER; note = uracil
  modified_base 23: mod_base = OTHER; note = uracil
  modified_base 32: mod_base = OTHER; note = uracil
  modified_base 33: mod_base = OTHER; note = uracil
  modified_base 39: mod_base = OTHER; note = uracil
  modified_base 42: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 62: mod_base = OTHER; note = uracil
  modified_base 64: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 90: mod_base = OTHER; note = uracil
  modified_base 99: mod_base = OTHER; note = uracil
  modified_base 102: mod_base = OTHER; note = uracil
  modified_base 113: mod_base = OTHER; note = uracil
  modified_base 118: mod_base = OTHER; note = uracil
  modified_base 121: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 132: mod_base = OTHER; note = uracil
  modified_base 143: mod_base = OTHER; note = uracil
  modified_base 146: mod_base = OTHER; note = uracil
  modified_base 154: mod_base = OTHER; note = uracil
  modified_base 155: mod_base = OTHER; note = uracil
  modified_base 161: mod_base = OTHER; note = uracil
  modified_base 162: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 171: mod_base = OTHER; note = uracil
  modified_base 176: mod_base = OTHER; note = uracil
  modified_base 186: mod_base = OTHER; note = uracil
  modified_base 187: mod_base = OTHER; note = uracil
  modified_base 194: mod_base = OTHER; note = uracil
  modified_base 195: mod_base = OTHER; note = uracil
  modified_base 206: mod_base = OTHER; note = uracil
  modified_base 210: mod_base = OTHER; note = uracil
  modified_base 211: mod_base = OTHER; note = uracil
  modified_base 223: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 236: mod_base = OTHER; note = uracil
  modified_base 250: mod_base = OTHER; note = uracil
  modified_base 251: mod_base = OTHER; note = uracil
  modified_base 261: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 283: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 294: mod_base = OTHER; note = uracil
gttaggtagggtgygttttyggtatgygtttttaaggattgttgagttattttaggggtgatttaggggtttaggggttaggttagagttaagggggatagtaggggagaggtygggttgtaaggttatagtaygggaagggtagtatgyggattagaggttaagttttttaatgtagaygagggttaggaggttagggaggaggttgtttygggagaaaygtygattgttttatttagggyggaygggttaggttygggttggtggaggtttttygggatgtaggttttgtatagggtt

SEQ ID NO: 327 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 13: mod_base = OTHER; note = uracil
  modified_base 16: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 26: mod_base = OTHER; note = uracil
  modified_base 41: mod_base = OTHER; note = uracil
  modified_base 46: mod_base = OTHER; note = uracil
  modified_base 47: mod_base = OTHER; note = uracil
  modified_base 55: mod_base = OTHER; note = uracil
  modified_base 65: mod_base = OTHER; note = uracil
  modified_base 79: mod_base = OTHER; note = uracil
  modified_base 80: mod_base = OTHER; note = uracil
  modified_base 85: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 118: mod_base = OTHER; note = uracil
  modified_base 120: mod_base = OTHER; note = uracil
  modified_base 125: mod_base = OTHER; note = uracil
  modified_base 128: mod_base = OTHER; note = uracil
  modified_base 130: mod_base = OTHER; note = uracil
  modified_base 133: mod_base = OTHER; note = uracil
  modified_base 137: mod_base = OTHER; note = uracil
  modified_base 139: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 182: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 208: mod_base = OTHER; note = uracil
  modified_base 209: mod_base = OTHER; note = uracil
  modified_base 241: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 264: mod_base = OTHER; note = uracil
  modified_base 277: mod_base = OTHER; note = uracil
  modified_base 289: mod_base = OTHER; note = uracil
  modified_base 294: mod_base = OTHER; note = uracil
  modified_base 296: mod_base = OTHER; note = uracil
ggaattattgttttgttgtttatagttgygtggagggatttyggttttygggtttagttggtgatagtgtygggtaggtttgggtaggtgggagaggtygtgaagttttttgtagggtatttggtygtttatttggtataggggaagaggygtagttygtggttyggtagtttaggatttgttgttttttttttattyggggyggggtttgtgggaagatatggaagtygggtgaatgagtygtgtttagtgattttaaaaagtagattaaaataatatagaaaatgttagagtttattg

SEQ ID NO: 328 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 10: mod_base = OTHER; note = uracil
  modified_base 14: mod_base = OTHER; note = uracil
  modified_base 20: mod_base = OTHER; note = uracil
  modified_base 35: mod_base = OTHER; note = uracil
  modified_base 38: mod_base = OTHER; note = uracil
  modified_base 49: mod_base = OTHER; note = uracil
  modified_base 51: mod_base = OTHER; note = uracil
  modified_base 56: mod_base = OTHER; note = uracil
  modified_base 61: mod_base = OTHER; note = uracil
  modified_base 63: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 117: mod_base = OTHER; note = uracil
  modified_base 120: mod_base = OTHER; note = uracil
  modified_base 125: mod_base = OTHER; note = uracil
  modified_base 126: mod_base = OTHER; note = uracil
  modified_base 131: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 146: mod_base = OTHER; note = uracil
  modified_base 151: mod_base = OTHER; note = uracil
  modified_base 152: mod_base = OTHER; note = uracil
  modified_base 154: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 166: mod_base = OTHER; note = uracil
  modified_base 177: mod_base = OTHER; note = uracil
  modified_base 178: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 196: mod_base = OTHER; note = uracil
  modified_base 199: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 232: mod_base = OTHER; note = uracil
  modified_base 234: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 249: mod_base = OTHER; note = uracil
  modified_base 250: mod_base = OTHER; note = uracil
  modified_base 257: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 276: mod_base = OTHER; note = uracil
  modified_base 283: mod_base = OTHER; note = uracil
  modified_base 286: mod_base = OTHER; note = uracil
  modified_base 291: mod_base = OTHER; note = uracil
  modified_base 299: mod_base = OTHER; note = uracil
  modified_base 300: mod_base = OTHER; note = uracil
taatgagttttgatattttttatgttattttaatttgttttttaaaattattgggtayggtttatttattygatttttatatttttttataggtttygtttygggtaggaagggaatagtaggttttggattgtygggttaygggttgygtttttttttttgtgttagatgagyggttaagtgttttgtaaagggttttaygattttttttatttgtttaggtttattygatattgttattaattgaattygaggatyggaatttttttaygtagttgtgggtagtagaataatggtttt

SEQ ID NO: 329 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 10: mod_base = OTHER; note = uracil
  modified_base 11: mod_base = OTHER; note = uracil
  modified_base 17: mod_base = OTHER; note = uracil
  modified_base 25: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 69: mod_base = OTHER; note = uracil
  modified_base 76: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 105: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 127: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 150: mod_base = OTHER; note = uracil
  modified_base 154: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 164: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 196: mod_base = OTHER; note = uracil
  modified_base 199: mod_base = OTHER; note = uracil
  modified_base 203: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 216: mod_base = OTHER; note = uracil
  modified_base 217: mod_base = OTHER; note = uracil
  modified_base 221: mod_base = OTHER; note = uracil
  modified_base 227: mod_base = OTHER; note = uracil
  modified_base 236: mod_base = OTHER; note = uracil
  modified_base 242: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 271: mod_base = OTHER; note = uracil
  modified_base 283: mod_base = OTHER; note = uracil
  modified_base 286: mod_base = OTHER; note = uracil
  modified_base 291: mod_base = OTHER; note = uracil
  modified_base 292: mod_base = OTHER; note = uracil
  modified_base 298: mod_base = OTHER; note = uracil
gtatttttatttgygttygaagygtagatggagtttaagggaaaggttttgtagaggatttygtgtgatttggggtaaagygtggttttttaggggtgygtgggtagygggaygtttatggtgtgatygggtttgtgtttttatagggatygtttgttttgtgtagagagtttttgtggggygggaagtggygagtagtyggtaaggaggtttagttagatagaagtaggggggttagggatatgggaggtgggggattagttagtgagttagaygtgaggattttagtgttaaggattg

SEQ ID NO: 330 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 11: mod_base = OTHER; note = uracil
  modified_base 13: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 28: mod_base = OTHER; note = uracil
  modified_base 32: mod_base = OTHER; note = uracil
  modified_base 34: mod_base = OTHER; note = uracil
  modified_base 36: mod_base = OTHER; note = uracil
  modified_base 40: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 78: mod_base = OTHER; note = uracil
  modified_base 82: mod_base = OTHER; note = uracil
  modified_base 86: mod_base = OTHER; note = uracil
  modified_base 91: mod_base = OTHER; note = uracil
  modified_base 92: mod_base = OTHER; note = uracil
  modified_base 94: mod_base = OTHER; note = uracil
  modified_base 95: mod_base = OTHER; note = uracil
  modified_base 99: mod_base = OTHER; note = uracil
  modified_base 103: mod_base = OTHER; note = uracil
  modified_base 106: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 140: mod_base = OTHER; note = uracil
  modified_base 145: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 164: mod_base = OTHER; note = uracil
  modified_base 166: mod_base = OTHER; note = uracil
  modified_base 170: mod_base = OTHER; note = uracil
  modified_base 171: mod_base = OTHER; note = uracil
  modified_base 176: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 190: mod_base = OTHER; note = uracil
  modified_base 191: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 216: mod_base = OTHER; note = uracil
  modified_base 217: mod_base = OTHER; note = uracil
  modified_base 221: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 234: mod_base = OTHER; note = uracil
  modified_base 236: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 279: mod_base = OTHER; note = uracil
  modified_base 288: mod_base = OTHER; note = uracil
  modified_base 300: mod_base = OTHER; note = uracil
tagtttttggtattgaagtttttaygtttgatttattggttggttttttattttttatgtttttgatttttttgtttttgtttggttgggtttttttgtyggttgttygttatttttygttttataggggttttttgtatagggtagayggtttttatggaggtataaattyggttatattatgggygtttygttgtttaygtatttttgggaggttaygttttgttttaagttatayggggttttttatagggttttttttttgggttttatttgygtttyggaygtaggtgaggatgt

SEQ ID NO: 331 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 42: mod_base = OTHER; note = uracil
  modified_base 43: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 57: mod_base = OTHER; note = uracil
  modified_base 59: mod_base = OTHER; note = uracil
  modified_base 60: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 80: mod_base = OTHER; note = uracil
  modified_base 95: mod_base = OTHER; note = uracil
  modified_base 96: mod_base = OTHER; note = uracil
  modified_base 103: mod_base = OTHER; note = uracil
  modified_base 104: mod_base = OTHER; note = uracil
  modified_base 112: mod_base = OTHER; note = uracil
  modified_base 114: mod_base = OTHER; note = uracil
  modified_base 119: mod_base = OTHER; note = uracil
  modified_base 121: mod_base = OTHER; note = uracil
  modified_base 128: mod_base = OTHER; note = uracil
  modified_base 136: mod_base = OTHER; note = uracil
  modified_base 137: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 155: mod_base = OTHER; note = uracil
  modified_base 157: mod_base = OTHER; note = uracil
  modified_base 160: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 172: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 188: mod_base = OTHER; note = uracil
  modified_base 205: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 224: mod_base = OTHER; note = uracil
  modified_base 233: mod_base = OTHER; note = uracil
  modified_base 236: mod_base = OTHER; note = uracil
  modified_base 241: mod_base = OTHER; note = uracil
  modified_base 245: mod_base = OTHER; note = uracil
  modified_base 248: mod_base = OTHER; note = uracil
  modified_base 251: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 296: mod_base = OTHER; note = uracil
  modified_base 298: mod_base = OTHER; note = uracil
  modified_base 299: mod_base = OTHER; note = uracil
aggttttttattttagtttttyggatttttatagggagtgtttagggatttttaatttttagggttatttttgtaggagttygggttygaggttttaygtggttagaagagtttaggtttttgagggttggtgtgttygggtatttattygtattattgttttttttttgttyggttaygtttagggttgagtgayggtggtggtaagtgtttgtttttagggtagygaggttttttgttttgatagtagtagggatttttttatggttattagtaattttagtgggyggaggygttttt

SEQ ID NO: 332 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 9: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 27: mod_base = OTHER; note = uracil
  modified_base 34: mod_base = OTHER; note = uracil
  modified_base 35: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 51: mod_base = OTHER; note = uracil
  modified_base 54: mod_base = OTHER; note = uracil
  modified_base 58: mod_base = OTHER; note = uracil
  modified_base 63: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 87: mod_base = OTHER; note = uracil
  modified_base 91: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 107: mod_base = OTHER; note = uracil
  modified_base 109: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 126: mod_base = OTHER; note = uracil
  modified_base 131: mod_base = OTHER; note = uracil
  modified_base 142: mod_base = OTHER; note = uracil
  modified_base 160: mod_base = OTHER; note = uracil
  modified_base 161: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 184: mod_base = OTHER; note = uracil
  modified_base 185: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 199: mod_base = OTHER; note = uracil
  modified_base 200: mod_base = OTHER; note = uracil
  modified_base 209: mod_base = OTHER; note = uracil
  modified_base 210: mod_base = OTHER; note = uracil
  modified_base 216: mod_base = OTHER; note = uracil
  modified_base 217: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 261: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 277: mod_base = OTHER; note = uracil
  modified_base 285: mod_base = OTHER; note = uracil
  modified_base 298: mod_base = OTHER; note = uracil
  modified_base 299: mod_base = OTHER; note = uracil
aggagygttttygtttattggggttattggtggttatgaaggagtttttgttgttgttagaatagaagatttygttgttttgaggataagtatttgttattatygttatttagttttgggygtagtyggataggaggagagtagtgatgyggatgggtattygggtatattagtttttagagatttgagtttttttggttaygtggaatttygaattygagtttttgtagaagtggttttggagattgagggtttttggatattttttatggagattyggggagttaggatggggaattt

SEQ ID NO: 333 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 6: mod_base = OTHER; note = uracil
  modified_base 7: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 22: mod_base = OTHER; note = uracil
  modified_base 24: mod_base = OTHER; note = uracil
  modified_base 26: mod_base = OTHER; note = uracil
  modified_base 28: mod_base = OTHER; note = uracil
  modified_base 33: mod_base = OTHER; note = uracil
  modified_base 37: mod_base = OTHER; note = uracil
  modified_base 42: mod_base = OTHER; note = uracil
  modified_base 47: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 61: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 83: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 103: mod_base = OTHER; note = uracil
  modified_base 111: mod_base = OTHER; note = uracil
  modified_base 112: mod_base = OTHER; note = uracil
  modified_base 115: mod_base = OTHER; note = uracil
  modified_base 122: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 147: mod_base = OTHER; note = uracil
  modified_base 156: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 180: mod_base = OTHER; note = uracil
  modified_base 186: mod_base = OTHER; note = uracil
  modified_base 189: mod_base = OTHER; note = uracil
  modified_base 197: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 241: mod_base = OTHER; note = uracil
  modified_base 249: mod_base = OTHER; note = uracil
  modified_base 260: mod_base = OTHER; note = uracil
  modified_base 265: mod_base = OTHER; note = uracil
  modified_base 270: mod_base = OTHER; note = uracil
  modified_base 278: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 296: mod_base = OTHER; note = uracil
  modified_base 297: mod_base = OTHER; note = uracil
  modified_base 298: mod_base = OTHER; note = uracil
  modified_base 300: mod_base = OTHER; note = uracil
tttttttttttttttttttttttttttttttttttttttttttttttttttttttttttttattttgagaygtattttggttttgtygtttaggttggagygtaatggygttatttyggygtattgtaatttttatttttygggtttaagygattttattgttttagtttttygagtagttgggattataggygygtattattaagttyggttaatttttttttgtatttttagtagagattgggttttaygatgttggtygggttggtttggaagttttgattttaagygtgygttttt

SEQ ID NO: 334 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 12: mod_base = OTHER; note = uracil
  modified_base 20: mod_base = OTHER; note = uracil
  modified_base 25: mod_base = OTHER; note = uracil
  modified_base 28: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 64: mod_base = OTHER; note = uracil
  modified_base 67: mod_base = OTHER; note = uracil
  modified_base 76: mod_base = OTHER; note = uracil
  modified_base 90: mod_base = OTHER; note = uracil
  modified_base 95: mod_base = OTHER; note = uracil
  modified_base 109: mod_base = OTHER; note = uracil
  modified_base 110: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 125: mod_base = OTHER; note = uracil
  modified_base 134: mod_base = OTHER; note = uracil
  modified_base 140: mod_base = OTHER; note = uracil
  modified_base 151: mod_base = OTHER; note = uracil
  modified_base 157: mod_base = OTHER; note = uracil
  modified_base 158: mod_base = OTHER; note = uracil
  modified_base 175: mod_base = OTHER; note = uracil
  modified_base 182: mod_base = OTHER; note = uracil
  modified_base 193: mod_base = OTHER; note = uracil
  modified_base 194: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 216: mod_base = OTHER; note = uracil
  modified_base 221: mod_base = OTHER; note = uracil
  modified_base 222: mod_base = OTHER; note = uracil
  modified_base 232: mod_base = OTHER; note = uracil
  modified_base 234: mod_base = OTHER; note = uracil
gagggygtaygtttgaggttaagatttttagattagttyggttaatatygtgaaatttagtttttattaaaaatataaaaaaaaattagtygggtttggtagtgygygtttgtagttttagttattygggaggttgaggtagtagaatygtttgaattygggaggtggaggttgtagtgygtygagatggygttattgygttttagtttgggygatagagttagagtaygttttaaaatgaaagaagagaaaagaaaagaaaagaaagaaaagagagagaaagaaggaaagaaggaagga

SEQ ID NO: 335 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 7: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 23: mod_base = OTHER; note = uracil
  modified_base 31: mod_base = OTHER; note = uracil
  modified_base 32: mod_base = OTHER; note = uracil
  modified_base 46: mod_base = OTHER; note = uracil
  modified_base 50: mod_base = OTHER; note = uracil
  modified_base 52: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 69: mod_base = OTHER; note = uracil
  modified_base 71: mod_base = OTHER; note = uracil
  modified_base 74: mod_base = OTHER; note = uracil
  modified_base 81: mod_base = OTHER; note = uracil
  modified_base 89: mod_base = OTHER; note = uracil
  modified_base 91: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 116: mod_base = OTHER; note = uracil
  modified_base 118: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 161: mod_base = OTHER; note = uracil
  modified_base 170: mod_base = OTHER; note = uracil
  modified_base 172: mod_base = OTHER; note = uracil
  modified_base 179: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 203: mod_base = OTHER; note = uracil
  modified_base 215: mod_base = OTHER; note = uracil
  modified_base 222: mod_base = OTHER; note = uracil
  modified_base 227: mod_base = OTHER; note = uracil
  modified_base 230: mod_base = OTHER; note = uracil
  modified_base 237: mod_base = OTHER; note = uracil
  modified_base 240: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 259: mod_base = OTHER; note = uracil
  modified_base 262: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 281: mod_base = OTHER; note = uracil
  modified_base 288: mod_base = OTHER; note = uracil
  modified_base 292: mod_base = OTHER; note = uracil
  modified_base 296: mod_base = OTHER; note = uracil
aggtttttgttgatttgtagaatttgttgattyggattttgatgttagttttattgggtttgtygttgttttttttgggatagaagatttttttgattyggttaattyggtagggtttaggggtatttaggttgttgtttttgatgtagtyggagtattttyggtagtgttttgggtataggtttttatttaygggtttttttygtgggygttttaygggattggatagtttgatgttgtagagaagtatttatttgatattaatgaattttttattttgtagtggttagttaggtatga

SEQ ID NO: 336 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 6: mod_base = OTHER; note = uracil
  modified_base 7: mod_base = OTHER; note = uracil
  modified_base 11: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 21: mod_base = OTHER; note = uracil
  modified_base 35: mod_base = OTHER; note = uracil
  modified_base 44: mod_base = OTHER; note = uracil
  modified_base 54: mod_base = OTHER; note = uracil
  modified_base 57: mod_base = OTHER; note = uracil
  modified_base 59: mod_base = OTHER; note = uracil
  modified_base 62: mod_base = OTHER; note = uracil
  modified_base 65: mod_base = OTHER; note = uracil
  modified_base 68: mod_base = OTHER; note = uracil
  modified_base 72: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 82: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 105: mod_base = OTHER; note = uracil
  modified_base 106: mod_base = OTHER; note = uracil
  modified_base 119: mod_base = OTHER; note = uracil
  modified_base 120: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 132: mod_base = OTHER; note = uracil
  modified_base 134: mod_base = OTHER; note = uracil
  modified_base 137: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 155: mod_base = OTHER; note = uracil
  modified_base 158: mod_base = OTHER; note = uracil
  modified_base 164: mod_base = OTHER; note = uracil
  modified_base 167: mod_base = OTHER; note = uracil
  modified_base 170: mod_base = OTHER; note = uracil
  modified_base 171: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 200: mod_base = OTHER; note = uracil
  modified_base 206: mod_base = OTHER; note = uracil
  modified_base 215: mod_base = OTHER; note = uracil
  modified_base 218: mod_base = OTHER; note = uracil
  modified_base 222: mod_base = OTHER; note = uracil
  modified_base 223: mod_base = OTHER; note = uracil
  modified_base 224: mod_base = OTHER; note = uracil
  modified_base 233: mod_base = OTHER; note = uracil
  modified_base 239: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 253: mod_base = OTHER; note = uracil
  modified_base 257: mod_base = OTHER; note = uracil
  modified_base 260: mod_base = OTHER; note = uracil
  modified_base 266: mod_base = OTHER; note = uracil
  modified_base 272: mod_base = OTHER; note = uracil
  modified_base 275: mod_base = OTHER; note = uracil
  modified_base 281: mod_base = OTHER; note = uracil
  modified_base 284: mod_base = OTHER; note = uracil
  modified_base 289: mod_base = OTHER; note = uracil
  modified_base 292: mod_base = OTHER; note = uracil
  modified_base 298: mod_base = OTHER; note = uracil
  modified_base 299: mod_base = OTHER; note = uracil
ttatgtttgattgattattgtaaggtggaaggtttattgatgttaagtgggtgtttttttgtagtattaagttgtttagtttygtgaaaygtttayggaaggagttygtggatgaggatttgtatttagagtattatyggaaatatttygattatattaaaggtagtaatttggatgtttttgagttttatygaattggtyggattaaagagattttttgttttaagaagagtaayggtaggtttaatgagattgatattaaaattygggttaataagttttataggttagtagaggttt

SEQ ID NO: 337 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 51: mod_base = OTHER; note = uracil
  modified_base 59: mod_base = OTHER; note = uracil
  modified_base 63: mod_base = OTHER; note = uracil
  modified_base 68: mod_base = OTHER; note = uracil
  modified_base 72: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 87: mod_base = OTHER; note = uracil
  modified_base 90: mod_base = OTHER; note = uracil
  modified_base 100: mod_base = OTHER; note = uracil
  modified_base 108: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 122: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 145: mod_base = OTHER; note = uracil
  modified_base 156: mod_base = OTHER; note = uracil
  modified_base 165: mod_base = OTHER; note = uracil
  modified_base 170: mod_base = OTHER; note = uracil
  modified_base 175: mod_base = OTHER; note = uracil
  modified_base 197: mod_base = OTHER; note = uracil
  modified_base 202: mod_base = OTHER; note = uracil
  modified_base 206: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 265: mod_base = OTHER; note = uracil
  modified_base 270: mod_base = OTHER; note = uracil
  modified_base 276: mod_base = OTHER; note = uracil
  modified_base 281: mod_base = OTHER; note = uracil
  modified_base 284: mod_base = OTHER; note = uracil
  modified_base 285: mod_base = OTHER; note = uracil
  modified_base 290: mod_base = OTHER; note = uracil
  modified_base 298: mod_base = OTHER; note = uracil
ggggyggggttyggtygggggyggyggtaggatttgagtagttaggagggttgggggatagttaggttaggtyggtggttattyggtygttggagagggtyggatggtaygtggtattaagtaaaaggaggttgagttagaaagtagggayggggttagaygagtaaagttgggtaggagggygagttgggaggggtygagtyggttgtgygtggttttttgggaggagggggtgtggttaagtaagttaaatagttyggaggttagtgtaaggataagatagtttgggtaaaygagtag

SEQ ID NO: 338 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 22: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 34: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 46: mod_base = OTHER; note = uracil
  modified_base 54: mod_base = OTHER; note = uracil
  modified_base 58: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 86: mod_base = OTHER; note = uracil
  modified_base 87: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 115: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 137: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 157: mod_base = OTHER; note = uracil
  modified_base 161: mod_base = OTHER; note = uracil
  modified_base 165: mod_base = OTHER; note = uracil
  modified_base 167: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 180: mod_base = OTHER; note = uracil
  modified_base 187: mod_base = OTHER; note = uracil
  modified_base 188: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 215: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 235: mod_base = OTHER; note = uracil
  modified_base 236: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 263: mod_base = OTHER; note = uracil
  modified_base 265: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 287: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ttgttygtttgtttaggttgttttgtttttgtattgattttygaattgtttggtttgtttggttatattttttttttttaagggattaygtatagtyggttyggttttttttaattygtttttttgtttagttttgttygtttagtttygtttttgttttttggtttagtttttttttgtttggtgttaygtgttattyggttttttttagyggtygggtagttatyggtttgatttgattgttttttagtttttttggttgtttaggttttgtygtygttttyggtygaatttygtttt

SEQ ID NO: 339 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 20: mod_base = OTHER; note = uracil
  modified_base 24: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 57: mod_base = OTHER; note = uracil
  modified_base 58: mod_base = OTHER; note = uracil
  modified_base 62: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 83: mod_base = OTHER; note = uracil
  modified_base 88: mod_base = OTHER; note = uracil
  modified_base 94: mod_base = OTHER; note = uracil
  modified_base 99: mod_base = OTHER; note = uracil
  modified_base 102: mod_base = OTHER; note = uracil
  modified_base 103: mod_base = OTHER; note = uracil
  modified_base 108: mod_base = OTHER; note = uracil
  modified_base 116: mod_base = OTHER; note = uracil
  modified_base 135: mod_base = OTHER; note = uracil
  modified_base 139: mod_base = OTHER; note = uracil
  modified_base 142: mod_base = OTHER; note = uracil
  modified_base 144: mod_base = OTHER; note = uracil
  modified_base 152: mod_base = OTHER; note = uracil
  modified_base 154: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 183: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 196: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 220: mod_base = OTHER; note = uracil
  modified_base 225: mod_base = OTHER; note = uracil
  modified_base 228: mod_base = OTHER; note = uracil
  modified_base 240: mod_base = OTHER; note = uracil
  modified_base 243: mod_base = OTHER; note = uracil
  modified_base 246: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 262: mod_base = OTHER; note = uracil
  modified_base 267: mod_base = OTHER; note = uracil
  modified_base 273: mod_base = OTHER; note = uracil
  modified_base 281: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 300: mod_base = OTHER; note = uracil
ygagttgggaggggtygagtyggttgtgygtggttttttgggaggagggggtgtggttaagtaagttaaatagttyggaggttagtgtaaggataagatagtttgggtaaaygagtaggggyggagygtgagagtagattgtatyggatygtttaggttagtttaagttgaagaggaaggggtaagttttagaagtaggggyggggtygattaatttygtagatttgttgggygaagagtagtagttgggttagttygatgttgtgtyggggtaggtagtttyggaggttgtttaggggt

SEQ ID NO: 340 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 4: mod_base = OTHER; note = uracil
  modified_base 9: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 21: mod_base = OTHER; note = uracil
  modified_base 24: mod_base = OTHER; note = uracil
  modified_base 25: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 46: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 55: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 78: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 105: mod_base = OTHER; note = uracil
  modified_base 108: mod_base = OTHER; note = uracil
  modified_base 114: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 153: mod_base = OTHER; note = uracil
  modified_base 159: mod_base = OTHER; note = uracil
  modified_base 163: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 174: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 199: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 215: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 227: mod_base = OTHER; note = uracil
  modified_base 235: mod_base = OTHER; note = uracil
  modified_base 239: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 274: mod_base = OTHER; note = uracil
  modified_base 277: mod_base = OTHER; note = uracil
  modified_base 281: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 296: mod_base = OTHER; note = uracil
  modified_base 300: mod_base = OTHER; note = uracil
tttttgggtagttttygagattatttgtttyggtatagtatygggttggtttagttgttgtttttygtttagtagatttgygaggttggtyggtttygtttttgtttttggagtttgtttttttttttttagtttgggttggtttgagygattyggtgtagtttgtttttaygtttygtttttgttygtttgtttaggttgttttgtttttgtattgattttygaattgtttggtttgtttggttatattttttttttttaagggattaygtatagtyggttyggttttttttaattygt

SEQ ID NO: 341 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 20: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 62: mod_base = OTHER; note = uracil
  modified_base 67: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 82: mod_base = OTHER; note = uracil
  modified_base 86: mod_base = OTHER; note = uracil
  modified_base 93: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 129: mod_base = OTHER; note = uracil
  modified_base 130: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 178: mod_base = OTHER; note = uracil
  modified_base 179: mod_base = OTHER; note = uracil
  modified_base 186: mod_base = OTHER; note = uracil
  modified_base 193: mod_base = OTHER; note = uracil
  modified_base 202: mod_base = OTHER; note = uracil
  modified_base 209: mod_base = OTHER; note = uracil
  modified_base 215: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 229: mod_base = OTHER; note = uracil
  modified_base 240: mod_base = OTHER; note = uracil
  modified_base 245: mod_base = OTHER; note = uracil
  modified_base 247: mod_base = OTHER; note = uracil
  modified_base 257: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 267: mod_base = OTHER; note = uracil
  modified_base 271: mod_base = OTHER; note = uracil
  modified_base 283: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 297: mod_base = OTHER; note = uracil
  modified_base 300: mod_base = OTHER; note = uracil
aataggtttaagtttgtggtaggtgggggttatttagtttaggygttttttattttygggtttgggttagaagtttaggagttggttgygggtyggtttttttttatttattttggggatgttttaggtttgggttttygttttagtttygttaggttttaatgagtttttgtttggtttgtagttaattgatyggttggatttggggtaggtgttygaggagttttattgagggagggtaggttttttgtgygtattgtttagtatatataggaaatttagtatttttgtttatttagt

SEQ ID NO: 342 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 11: mod_base = OTHER; note = uracil
  modified_base 19: mod_base = OTHER; note = uracil
  modified_base 27: mod_base = OTHER; note = uracil
  modified_base 28: mod_base = OTHER; note = uracil
  modified_base 37: mod_base = OTHER; note = uracil
  modified_base 42: mod_base = OTHER; note = uracil
  modified_base 49: mod_base = OTHER; note = uracil
  modified_base 51: mod_base = OTHER; note = uracil
  modified_base 58: mod_base = OTHER; note = uracil
  modified_base 59: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 105: mod_base = OTHER; note = uracil
  modified_base 110: mod_base = OTHER; note = uracil
  modified_base 117: mod_base = OTHER; note = uracil
  modified_base 120: mod_base = OTHER; note = uracil
  modified_base 124: mod_base = OTHER; note = uracil
  modified_base 125: mod_base = OTHER; note = uracil
  modified_base 129: mod_base = OTHER; note = uracil
  modified_base 135: mod_base = OTHER; note = uracil
  modified_base 137: mod_base = OTHER; note = uracil
  modified_base 145: mod_base = OTHER; note = uracil
  modified_base 146: mod_base = OTHER; note = uracil
  modified_base 155: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 173: mod_base = OTHER; note = uracil
  modified_base 174: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 205: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 222: mod_base = OTHER; note = uracil
  modified_base 223: mod_base = OTHER; note = uracil
  modified_base 228: mod_base = OTHER; note = uracil
  modified_base 231: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 241: mod_base = OTHER; note = uracil
  modified_base 242: mod_base = OTHER; note = uracil
  modified_base 258: mod_base = OTHER; note = uracil
  modified_base 259: mod_base = OTHER; note = uracil
  modified_base 264: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 289: mod_base = OTHER; note = uracil
  modified_base 295: mod_base = OTHER; note = uracil
  modified_base 296: mod_base = OTHER; note = uracil
gttgggtgggtagaaatgttaaattttttgtatgtgttggatagtaygtataagagatttgtttttttttagtggggtttttygagtatttgttttaagtttaatyggttaattgattataggttaaatagaggtttattggggtttggygaggttaaggyggaaatttaggtttgaggtatttttagagtgggtgggggagaatyggttygtagttagtttttgggtttttggtttaggttygggggtgggaagygtttgggttgggtgatttttatttgttataggtttgggtttgtt

SEQ ID NO: 343 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 15: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 36: mod_base = OTHER; note = uracil
  modified_base 38: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 51: mod_base = OTHER; note = uracil
  modified_base 54: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 105: mod_base = OTHER; note = uracil
  modified_base 110: mod_base = OTHER; note = uracil
  modified_base 112: mod_base = OTHER; note = uracil
  modified_base 121: mod_base = OTHER; note = uracil
  modified_base 122: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 142: mod_base = OTHER; note = uracil
  modified_base 143: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 162: mod_base = OTHER; note = uracil
  modified_base 168: mod_base = OTHER; note = uracil
  modified_base 171: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 198: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 239: mod_base = OTHER; note = uracil
  modified_base 245: mod_base = OTHER; note = uracil
  modified_base 246: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 261: mod_base = OTHER; note = uracil
  modified_base 268: mod_base = OTHER; note = uracil
  modified_base 283: mod_base = OTHER; note = uracil
  modified_base 295: mod_base = OTHER; note = uracil
tttgatttatttaatttttttaggggaygtgggggtattggagttttatatygtaggyggtagtttaatgtattygygtyggagtttttttttygygagygtggtaaggtttagggaagtttygggtttttggggagggggttttgtygygtattttgtygtaggaatygtygggttttttttttygygggaagyggtttggtygattttygttttygttygggttttttgggggttttyggtgttyggttatygtggggttggggattgaaagtgatgggattgaagatggggttggaa

SEQ ID NO: 344 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 13: mod_base = OTHER; note = uracil
  modified_base 16: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 27: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 52: mod_base = OTHER; note = uracil
  modified_base 57: mod_base = OTHER; note = uracil
  modified_base 59: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 77: mod_base = OTHER; note = uracil
  modified_base 78: mod_base = OTHER; note = uracil
  modified_base 99: mod_base = OTHER; note = uracil
  modified_base 100: mod_base = OTHER; note = uracil
  modified_base 104: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 126: mod_base = OTHER; note = uracil
  modified_base 127: mod_base = OTHER; note = uracil
  modified_base 136: mod_base = OTHER; note = uracil
  modified_base 137: mod_base = OTHER; note = uracil
  modified_base 143: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 175: mod_base = OTHER; note = uracil
  modified_base 176: mod_base = OTHER; note = uracil
  modified_base 182: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 217: mod_base = OTHER; note = uracil
  modified_base 219: mod_base = OTHER; note = uracil
  modified_base 231: mod_base = OTHER; note = uracil
  modified_base 238: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 258: mod_base = OTHER; note = uracil
  modified_base 260: mod_base = OTHER; note = uracil
  modified_base 261: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 297: mod_base = OTHER; note = uracil
ttttagttttatttttagttttattatttttagtttttagttttayggtggtygggtatyggaaatttttaagaggttygggygggggygggggtyggttaagtygtttttygyggaaggaagggttyggyggtttttgygataggatgygyggtaaggttttttttttaggggttygggatttttttgagttttgttaygttygygggggaggaatttygaygygggtgtattgagttatygtttgyggtgtggggttttagtgtttttaygttttttgggagagttgggtgggttagg

SEQ ID NO: 345 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 36: mod_base = OTHER; note = uracil
  modified_base 41: mod_base = OTHER; note = uracil
  modified_base 43: mod_base = OTHER; note = uracil
  modified_base 56: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 81: mod_base = OTHER; note = uracil
  modified_base 83: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 128: mod_base = OTHER; note = uracil
  modified_base 133: mod_base = OTHER; note = uracil
  modified_base 136: mod_base = OTHER; note = uracil
  modified_base 140: mod_base = OTHER; note = uracil
  modified_base 143: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 171: mod_base = OTHER; note = uracil
  modified_base 175: mod_base = OTHER; note = uracil
  modified_base 205: mod_base = OTHER; note = uracil
  modified_base 216: mod_base = OTHER; note = uracil
  modified_base 223: mod_base = OTHER; note = uracil
  modified_base 225: mod_base = OTHER; note = uracil
  modified_base 231: mod_base = OTHER; note = uracil
  modified_base 259: mod_base = OTHER; note = uracil
  modified_base 273: mod_base = OTHER; note = uracil
  modified_base 284: mod_base = OTHER; note = uracil
  modified_base 291: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 300: mod_base = OTHER; note = uracil
tatttaaatgtgttttatataaaatgaatygtttttagtgtattgaggaagttttttatttaaagaaattttgttgtgaatttttttgtgaagaatgtttttttaatggaattagttattattgagttatttttgtaaattttaggtttgyggttttgtttaagtaagatttggtyggagaagtgagataaattatagatgtygttaataaattatagattatttaaaggtaaaagaggaaagaaaaaaaaaaattgattygtgtatatgaatygaattgagttaggggtttttatyggt

SEQ ID NO: 346 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 19: mod_base = OTHER; note = uracil
  modified_base 21: mod_base = OTHER; note = uracil
  modified_base 31: mod_base = OTHER; note = uracil
  modified_base 37: mod_base = OTHER; note = uracil
  modified_base 44: mod_base = OTHER; note = uracil
  modified_base 58: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 71: mod_base = OTHER; note = uracil
  modified_base 72: mod_base = OTHER; note = uracil
  modified_base 83: mod_base = OTHER; note = uracil
  modified_base 100: mod_base = OTHER; note = uracil
  modified_base 103: mod_base = OTHER; note = uracil
  modified_base 114: mod_base = OTHER; note = uracil
  modified_base 116: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 137: mod_base = OTHER; note = uracil
  modified_base 143: mod_base = OTHER; note = uracil
  modified_base 148: mod_base = OTHER; note = uracil
  modified_base 151: mod_base = OTHER; note = uracil
  modified_base 155: mod_base = OTHER; note = uracil
  modified_base 156: mod_base = OTHER; note = uracil
  modified_base 166: mod_base = OTHER; note = uracil
  modified_base 175: mod_base = OTHER; note = uracil
  modified_base 177: mod_base = OTHER; note = uracil
  modified_base 186: mod_base = OTHER; note = uracil
  modified_base 192: mod_base = OTHER; note = uracil
  modified_base 193: mod_base = OTHER; note = uracil
  modified_base 204: mod_base = OTHER; note = uracil
  modified_base 208: mod_base = OTHER; note = uracil
  modified_base 211: mod_base = OTHER; note = uracil
  modified_base 213: mod_base = OTHER; note = uracil
  modified_base 223: mod_base = OTHER; note = uracil
  modified_base 225: mod_base = OTHER; note = uracil
  modified_base 228: mod_base = OTHER; note = uracil
  modified_base 236: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 261: mod_base = OTHER; note = uracil
  modified_base 263: mod_base = OTHER; note = uracil
  modified_base 275: mod_base = OTHER; note = uracil
  modified_base 289: mod_base = OTHER; note = uracil
  modified_base 291: mod_base = OTHER; note = uracil
gtyggtggagatttttgatttaattyggtttatatataygagttaatttttttttttttttttttttttgtttttgagtaatttgtaatttattagygatatttataatttattttattttttyggttagattttgtttaggtaaaatygtaaatttgaagtttgtagaaatgatttagtggtgattaattttattaggaaagtattttttataaaagagtttatagtaggatttttttaaatagaaaatttttttagtgtattgaaaaygatttattttatataaaatatatttggata

SEQ ID NO: 347 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 33: mod_base = OTHER; note = uracil
  modified_base 39: mod_base = OTHER; note = uracil
  modified_base 44: mod_base = OTHER; note = uracil
  modified_base 46: mod_base = OTHER; note = uracil
  modified_base 49: mod_base = OTHER; note = uracil
  modified_base 52: mod_base = OTHER; note = uracil
  modified_base 54: mod_base = OTHER; note = uracil
  modified_base 59: mod_base = OTHER; note = uracil
  modified_base 60: mod_base = OTHER; note = uracil
  modified_base 66: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 90: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 114: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 129: mod_base = OTHER; note = uracil
  modified_base 132: mod_base = OTHER; note = uracil
  modified_base 139: mod_base = OTHER; note = uracil
  modified_base 142: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 160: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 178: mod_base = OTHER; note = uracil
  modified_base 179: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 195: mod_base = OTHER; note = uracil
  modified_base 197: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 222: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 281: mod_base = OTHER; note = uracil
  modified_base 294: mod_base = OTHER; note = uracil
  modified_base 295: mod_base = OTHER; note = uracil
  modified_base 297: mod_base = OTHER; note = uracil
tgggagttttagttygggggtagattagtgtttagagttygggttttgttatttagygttygaggtagygtttttttatttaaygggggtygtggtaattttttgatatgatttatgattatataatatattyggaaatttttttttatygtttttygtttgggtygtygttttyggtttgggagattttaggttttagagtttttgtttttaygggygattagtgttgtttagtggaaaaataatgttagtygygtattaaaattaggtgtaaaattaatattttttggaagttatttt

SEQ ID NO: 348 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 10: mod_base = OTHER; note = uracil
  modified_base 11: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 49: mod_base = OTHER; note = uracil
  modified_base 53: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 83: mod_base = OTHER; note = uracil
  modified_base 84: mod_base = OTHER; note = uracil
  modified_base 93: mod_base = OTHER; note = uracil
  modified_base 99: mod_base = OTHER; note = uracil
  modified_base 101: mod_base = OTHER; note = uracil
  modified_base 107: mod_base = OTHER; note = uracil
  modified_base 108: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 165: mod_base = OTHER; note = uracil
  modified_base 183: mod_base = OTHER; note = uracil
  modified_base 190: mod_base = OTHER; note = uracil
  modified_base 195: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 244: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 263: mod_base = OTHER; note = uracil
  modified_base 265: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 298: mod_base = OTHER; note = uracil
aagtggtttttaaaaaatgttaattttatatttaattttggtgygyggttggtattatttttttattgggtagtattgatygttygtgggggtagagattttgagatttggagttttttaggtygggggygayggtttagaygggaggyggtggagagaagttttyggatgtattatgtggttatgaattatgttagggaattgttayggttttygttgaatggggaggygttgtttygggygttgagtagtagagttyggattttgaatattggtttgttttygaattggaatttttat

SEQ ID NO: 349 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 11: mod_base = OTHER; note = uracil
  modified_base 16: mod_base = OTHER; note = uracil
  modified_base 20: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 36: mod_base = OTHER; note = uracil
  modified_base 39: mod_base = OTHER; note = uracil
  modified_base 42: mod_base = OTHER; note = uracil
  modified_base 45: mod_base = OTHER; note = uracil
  modified_base 47: mod_base = OTHER; note = uracil
  modified_base 53: mod_base = OTHER; note = uracil
  modified_base 56: mod_base = OTHER; note = uracil
  modified_base 58: mod_base = OTHER; note = uracil
  modified_base 64: mod_base = OTHER; note = uracil
  modified_base 65: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 77: mod_base = OTHER; note = uracil
  modified_base 79: mod_base = OTHER; note = uracil
  modified_base 85: mod_base = OTHER; note = uracil
  modified_base 92: mod_base = OTHER; note = uracil
  modified_base 95: mod_base = OTHER; note = uracil
  modified_base 107: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 128: mod_base = OTHER; note = uracil
  modified_base 130: mod_base = OTHER; note = uracil
  modified_base 134: mod_base = OTHER; note = uracil
  modified_base 138: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 161: mod_base = OTHER; note = uracil
  modified_base 170: mod_base = OTHER; note = uracil
  modified_base 176: mod_base = OTHER; note = uracil
  modified_base 178: mod_base = OTHER; note = uracil
  modified_base 185: mod_base = OTHER; note = uracil
  modified_base 197: mod_base = OTHER; note = uracil
  modified_base 211: mod_base = OTHER; note = uracil
  modified_base 235: mod_base = OTHER; note = uracil
  modified_base 238: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 263: mod_base = OTHER; note = uracil
  modified_base 266: mod_base = OTHER; note = uracil
  modified_base 267: mod_base = OTHER; note = uracil
  modified_base 273: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 289: mod_base = OTHER; note = uracil
  modified_base 291: mod_base = OTHER; note = uracil
  modified_base 295: mod_base = OTHER; note = uracil
yggygtgttttttggtaaatatttttttgaggatgtygttgtagtatttgagttgtttygagattttgttgtttttttttggtgttgggtgttgttgagagtygggtaygtttttttttggaggttttataggtyggttgttttttygtygttggtttagtttggtggttttgggtttygggggtagygagggtggttygtgaatggggttaatggtggtgggggtggtggtgtttgtttttttttttatttttttttttgtttgttaagaatayggaygttaataggtatagttagaag

SEQ ID NO: 350 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 24: mod_base = OTHER; note = uracil
  modified_base 31: mod_base = OTHER; note = uracil
  modified_base 36: mod_base = OTHER; note = uracil
  modified_base 40: mod_base = OTHER; note = uracil
  modified_base 64: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 99: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 146: mod_base = OTHER; note = uracil
  modified_base 147: mod_base = OTHER; note = uracil
  modified_base 161: mod_base = OTHER; note = uracil
  modified_base 164: mod_base = OTHER; note = uracil
  modified_base 168: mod_base = OTHER; note = uracil
  modified_base 169: mod_base = OTHER; note = uracil
  modified_base 177: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 202: mod_base = OTHER; note = uracil
  modified_base 204: mod_base = OTHER; note = uracil
  modified_base 207: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 230: mod_base = OTHER; note = uracil
  modified_base 233: mod_base = OTHER; note = uracil
  modified_base 239: mod_base = OTHER; note = uracil
  modified_base 246: mod_base = OTHER; note = uracil
  modified_base 249: mod_base = OTHER; note = uracil
  modified_base 251: mod_base = OTHER; note = uracil
  modified_base 257: mod_base = OTHER; note = uracil
  modified_base 260: mod_base = OTHER; note = uracil
  modified_base 266: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 286: mod_base = OTHER; note = uracil
  modified_base 287: mod_base = OTHER; note = uracil
  modified_base 294: mod_base = OTHER; note = uracil
  modified_base 298: mod_base = OTHER; note = uracil
tttttgattgtgtttgttggygttygtgtttttggtagataaagaagggagtgaagaggaaagtagatattattatttttattattattgattttatttaygagttattttygttgttttyggagtttaagattattaagttgggttagyggygggagagtagtyggtttgtgaaatttttaaagaaggaygtgttygatttttagtagtatttagtattagagaagagtagtaaggtttyggagtagtttaagtgttgtagyggtatttttaaggagatgtttgttaagaagtaygtyg

SEQ ID NO: 351 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 8: mod_base = OTHER; note = uracil
  modified_base 11: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 49: mod_base = OTHER; note = uracil
  modified_base 52: mod_base = OTHER; note = uracil
  modified_base 58: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 85: mod_base = OTHER; note = uracil
  modified_base 95: mod_base = OTHER; note = uracil
  modified_base 96: mod_base = OTHER; note = uracil
  modified_base 103: mod_base = OTHER; note = uracil
  modified_base 112: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 171: mod_base = OTHER; note = uracil
  modified_base 172: mod_base = OTHER; note = uracil
  modified_base 175: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 189: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 203: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 245: mod_base = OTHER; note = uracil
  modified_base 254: mod_base = OTHER; note = uracil
  modified_base 263: mod_base = OTHER; note = uracil
  modified_base 264: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 282: mod_base = OTHER; note = uracil
  modified_base 287: mod_base = OTHER; note = uracil
  modified_base 290: mod_base = OTHER; note = uracil
tggtttgttttaagttttatttggtttttggtaagttttatttggtgatattttgtgtttgggtttttgagggttgttttagattygygattgttttggggatyggtagttttttttyggatgttagtaaagttttttttagtttttaygtttgtatagtttttagtatgtttttaatagttattagttattttttgtgagttagattttyggttttgttaggttaatttgtttggggttttagtagygggggttggygaggttagttttttttagyggttttaagtygttygagggtgg

SEQ ID NO: 352 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 5: mod_base = OTHER; note = uracil
  modified_base 14: mod_base = OTHER; note = uracil
  modified_base 21: mod_base = OTHER; note = uracil
  modified_base 24: mod_base = OTHER; note = uracil
  modified_base 34: mod_base = OTHER; note = uracil
  modified_base 38: mod_base = OTHER; note = uracil
  modified_base 39: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 53: mod_base = OTHER; note = uracil
  modified_base 56: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 69: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 87: mod_base = OTHER; note = uracil
  modified_base 95: mod_base = OTHER; note = uracil
  modified_base 99: mod_base = OTHER; note = uracil
  modified_base 101: mod_base = OTHER; note = uracil
  modified_base 103: mod_base = OTHER; note = uracil
  modified_base 113: mod_base = OTHER; note = uracil
  modified_base 120: mod_base = OTHER; note = uracil
  modified_base 130: mod_base = OTHER; note = uracil
  modified_base 134: mod_base = OTHER; note = uracil
  modified_base 141: mod_base = OTHER; note = uracil
  modified_base 146: mod_base = OTHER; note = uracil
  modified_base 158: mod_base = OTHER; note = uracil
  modified_base 168: mod_base = OTHER; note = uracil
  modified_base 173: mod_base = OTHER; note = uracil
  modified_base 177: mod_base = OTHER; note = uracil
  modified_base 180: mod_base = OTHER; note = uracil
  modified_base 191: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 207: mod_base = OTHER; note = uracil
  modified_base 218: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 243: mod_base = OTHER; note = uracil
  modified_base 245: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 265: mod_base = OTHER; note = uracil
  modified_base 269: mod_base = OTHER; note = uracil
  modified_base 270: mod_base = OTHER; note = uracil
  modified_base 276: mod_base = OTHER; note = uracil
  modified_base 277: mod_base = OTHER; note = uracil
  modified_base 286: mod_base = OTHER; note = uracil
  modified_base 293: mod_base = OTHER; note = uracil
  modified_base 297: mod_base = OTHER; note = uracil
  modified_base 298: mod_base = OTHER; note = uracil
tattttygagyggtttagaatygttggagaaaattggtttygttagttttygttgttgaggttttaagtaggttggtttggtaggatygggggtttgatttatagagggtgattaatggttgttgaaggtatattggagattgtgtaggygtggaggttggagggagttttgttggtattyggggaggaattatyggtttttaggataatygyggatttggggtagtttttaaggatttaggtataagatgttattaagtgggatttgttaggggttaggtaggatttgaagtagattag

SEQ ID NO: 353 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 18: mod_base = OTHER; note = uracil
  modified_base 21: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 61: mod_base = OTHER; note = uracil
  modified_base 69: mod_base = OTHER; note = uracil
  modified_base 72: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 88: mod_base = OTHER; note = uracil
  modified_base 90: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 110: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 136: mod_base = OTHER; note = uracil
  modified_base 145: mod_base = OTHER; note = uracil
  modified_base 149: mod_base = OTHER; note = uracil
  modified_base 152: mod_base = OTHER; note = uracil
  modified_base 155: mod_base = OTHER; note = uracil
  modified_base 165: mod_base = OTHER; note = uracil
  modified_base 167: mod_base = OTHER; note = uracil
  modified_base 174: mod_base = OTHER; note = uracil
  modified_base 177: mod_base = OTHER; note = uracil
  modified_base 180: mod_base = OTHER; note = uracil
  modified_base 189: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 221: mod_base = OTHER; note = uracil
  modified_base 223: mod_base = OTHER; note = uracil
  modified_base 226: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 239: mod_base = OTHER; note = uracil
  modified_base 242: mod_base = OTHER; note = uracil
  modified_base 243: mod_base = OTHER; note = uracil
  modified_base 248: mod_base = OTHER; note = uracil
  modified_base 253: mod_base = OTHER; note = uracil
  modified_base 254: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 278: mod_base = OTHER; note = uracil
  modified_base 279: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 291: mod_base = OTHER; note = uracil
  modified_base 300: mod_base = OTHER; note = uracil
atttggtyggttatyggtagttyggggaagaagggygygtggygygtttattttayggtgttgaagagtagtygygtygttagttygtataygttgtygatgtttagtatygygttygtygygtygttttttgygtygaagygttyggtygtygtagggtagggtttagygygtagtagttgygygattagttyggatatyggttgtttygggaagaggttttygtygttygttattgtygttagygtygagttyggggggttgttygaggaggyggttayggtattaggtagygagtgt

SEQ ID NO: 354 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 8: mod_base = OTHER; note = uracil
  modified_base 11: mod_base = OTHER; note = uracil
  modified_base 12: mod_base = OTHER; note = uracil
  modified_base 18: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 49: mod_base = OTHER; note = uracil
  modified_base 56: mod_base = OTHER; note = uracil
  modified_base 63: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 95: mod_base = OTHER; note = uracil
  modified_base 98: mod_base = OTHER; note = uracil
  modified_base 105: mod_base = OTHER; note = uracil
  modified_base 110: mod_base = OTHER; note = uracil
  modified_base 119: mod_base = OTHER; note = uracil
  modified_base 122: mod_base = OTHER; note = uracil
  modified_base 125: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 153: mod_base = OTHER; note = uracil
  modified_base 160: mod_base = OTHER; note = uracil
  modified_base 168: mod_base = OTHER; note = uracil
  modified_base 194: mod_base = OTHER; note = uracil
  modified_base 199: mod_base = OTHER; note = uracil
  modified_base 205: mod_base = OTHER; note = uracil
  modified_base 218: mod_base = OTHER; note = uracil
  modified_base 230: mod_base = OTHER; note = uracil
  modified_base 233: mod_base = OTHER; note = uracil
  modified_base 235: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 259: mod_base = OTHER; note = uracil
  modified_base 260: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 281: mod_base = OTHER; note = uracil
  modified_base 284: mod_base = OTHER; note = uracil
  modified_base 291: mod_base = OTHER; note = uracil
  modified_base 295: mod_base = OTHER; note = uracil
  modified_base 296: mod_base = OTHER; note = uracil
gtattygttgtttggtgtygtggtygttttttygggtagtttttygggttyggygttggyggtagtggygagyggyggagattttttttyggggtagtyggtgttygaattgatygygtagttgttgygygttgagttttattttgyggyggtyggaygtttyggygtagggggyggygyggygggygyggtgttgggtatygataaygtgtgygagttggyggygyggttgttttttagtatygtggagtgggygygttaygygtttttttttttygagttgtyggtggtygattaggt

SEQ ID NO: 355 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 12: mod_base = OTHER; note = uracil
  modified_base 18: mod_base = OTHER; note = uracil
  modified_base 19: mod_base = OTHER; note = uracil
  modified_base 26: mod_base = OTHER; note = uracil
  modified_base 59: mod_base = OTHER; note = uracil
  modified_base 67: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 93: mod_base = OTHER; note = uracil
  modified_base 104: mod_base = OTHER; note = uracil
  modified_base 106: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 130: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 143: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 161: mod_base = OTHER; note = uracil
  modified_base 162: mod_base = OTHER; note = uracil
  modified_base 166: mod_base = OTHER; note = uracil
  modified_base 170: mod_base = OTHER; note = uracil
  modified_base 172: mod_base = OTHER; note = uracil
  modified_base 174: mod_base = OTHER; note = uracil
  modified_base 183: mod_base = OTHER; note = uracil
  modified_base 194: mod_base = OTHER; note = uracil
  modified_base 203: mod_base = OTHER; note = uracil
  modified_base 204: mod_base = OTHER; note = uracil
  modified_base 218: mod_base = OTHER; note = uracil
  modified_base 246: mod_base = OTHER; note = uracil
  modified_base 254: mod_base = OTHER; note = uracil
  modified_base 255: mod_base = OTHER; note = uracil
  modified_base 259: mod_base = OTHER; note = uracil
  modified_base 264: mod_base = OTHER; note = uracil
  modified_base 265: mod_base = OTHER; note = uracil
  modified_base 273: mod_base = OTHER; note = uracil
  modified_base 285: mod_base = OTHER; note = uracil
  modified_base 291: mod_base = OTHER; note = uracil
  modified_base 297: mod_base = OTHER; note = uracil
  modified_base 299: mod_base = OTHER; note = uracil
tggtagagatataaatttttgatggtagaggagggagagagagtgtgggtgaygatgataattgaattgagatttaaaggaggtaggggagatatatgggygtttttgggaagatggttttygggaaagtatagtttttagataggtttygaggtaggagtttgtttgatttatyggaggagtttggaggaggttgaggtggtttaagtygattaagtagggtggggagggaagaggygatggtgtygtgagattaagtagggttttgaggtttggggggagaattttggtttttatttt

SEQ ID NO: 356 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 11: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 48: mod_base = OTHER; note = uracil
  modified_base 50: mod_base = OTHER; note = uracil
  modified_base 55: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 92: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 132: mod_base = OTHER; note = uracil
  modified_base 136: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 146: mod_base = OTHER; note = uracil
  modified_base 147: mod_base = OTHER; note = uracil
  modified_base 154: mod_base = OTHER; note = uracil
  modified_base 155: mod_base = OTHER; note = uracil
  modified_base 159: mod_base = OTHER; note = uracil
  modified_base 166: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 183: mod_base = OTHER; note = uracil
  modified_base 184: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 229: mod_base = OTHER; note = uracil
  modified_base 231: mod_base = OTHER; note = uracil
  modified_base 236: mod_base = OTHER; note = uracil
  modified_base 243: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 261: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 279: mod_base = OTHER; note = uracil
  modified_base 292: mod_base = OTHER; note = uracil
  modified_base 294: mod_base = OTHER; note = uracil
  modified_base 297: mod_base = OTHER; note = uracil
  modified_base 298: mod_base = OTHER; note = uracil
gagtaaaagttaaagttttttttttagattttaaggttttgtttggttttayggtattatygttttttttttttttattttgtttaatygatttaggttattttagttttttttaagttttttyggtgagttagataggtttttgtttyggggtttgtttaaaggttgtgttttttyggggattatttttttagagaygtttatatgttttttttattttttttgggttttagtttaattgttatygttatttatatttttttttttttttttgttattaggaatttgtatttttgttag

SEQ ID NO: 357 - DNA, 300 bp, synthetic construct
  misc_feature 1..300: note = Synthetic polynucleotide
  source 1..300: mol_type = other DNA
  modified_base 33: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 67: mod_base = OTHER; note = uracil
  modified_base 78: mod_base = OTHER; note = uracil
  modified_base 80: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 104: mod_base = OTHER; note = uracil
  modified_base 106: mod_base = OTHER; note = uracil
  modified_base 109: mod_base = OTHER; note = uracil
  modified_base 110: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 129: mod_base = OTHER; note = uracil
  modified_base 135: mod_base = OTHER; note = uracil
  modified_base 136: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 157: mod_base = OTHER; note = uracil
  modified_base 168: mod_base = OTHER; note = uracil
  modified_base 177: mod_base = OTHER; note = uracil
  modified_base 178: mod_base = OTHER; note = uracil
  modified_base 192: mod_base = OTHER; note = uracil
  modified_base 220: mod_base = OTHER; note = uracil
  modified_base 228: mod_base = OTHER; note = uracil
  modified_base 229: mod_base = OTHER; note = uracil
  modified_base 233: mod_base = OTHER; note = uracil
  modified_base 238: mod_base = OTHER; note = uracil
  modified_base 239: mod_base = OTHER; note = uracil
  modified_base 247: mod_base = OTHER; note = uracil
  modified_base 259: mod_base = OTHER; note = uracil
  modified_base 265: mod_base = OTHER; note = uracil
  modified_base 271: mod_base = OTHER; note = uracil
  modified_base 273: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 298: mod_base = OTHER; note = uracil
agaggagggagagagagtgtgggtgaygatgataattgaattgagatttaaaggaggtaggggagatatatgggygtttttgggaagatggttttygggaaagtatagtttttagataggtttygaggtaggagtttgtttgatttatyggaggagtttggaggaggttgaggtggtttaagtygattaagtagggtggggagggaagaggygatggtgtygtgagattaagtagggttttgaggtttggggggagaattttggtttttattttgaggaaggtgggagttatagaggttt

SEQ ID NO: 358 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 36: mod_base = OTHER; note = uracil
  modified_base 37: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 68: mod_base = OTHER; note = uracil
  modified_base 74: mod_base = OTHER; note = uracil
  modified_base 76: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 149: mod_base = OTHER; note = uracil
  modified_base 158: mod_base = OTHER; note = uracil
  modified_base 162: mod_base = OTHER; note = uracil
  modified_base 166: mod_base = OTHER; note = uracil
  modified_base 168: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 192: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 255: mod_base = OTHER; note = uracil
  modified_base 257: mod_base = OTHER; note = uracil
  modified_base 262: mod_base = OTHER; note = uracil
  modified_base 269: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 298: mod_base = OTHER; note = uracil
agtttttgtggtttttattttttttagagtaaaagttaaagttttttttttagattttaaggttttgtttggttttayggtattatygttttttttttttttattttgtttaatygatttaggttattttagttttttttaagttttttyggtgagttagataggtttttgtttyggggtttgtttaaaggttgtgttttttyggggattatttttttagagaygtttatatgttttttttattttttttgggttttagtttaattgttatygttatttatatttttttttttttttttg

SEQ ID NO: 359 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 10: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 78: mod_base = OTHER; note = uracil
  modified_base 87: mod_base = OTHER; note = uracil
  modified_base 98: mod_base = OTHER; note = uracil
  modified_base 107: mod_base = OTHER; note = uracil
  modified_base 108: mod_base = OTHER; note = uracil
  modified_base 122: mod_base = OTHER; note = uracil
  modified_base 150: mod_base = OTHER; note = uracil
  modified_base 158: mod_base = OTHER; note = uracil
  modified_base 159: mod_base = OTHER; note = uracil
  modified_base 163: mod_base = OTHER; note = uracil
  modified_base 168: mod_base = OTHER; note = uracil
  modified_base 169: mod_base = OTHER; note = uracil
  modified_base 177: mod_base = OTHER; note = uracil
  modified_base 189: mod_base = OTHER; note = uracil
  modified_base 195: mod_base = OTHER; note = uracil
  modified_base 201: mod_base = OTHER; note = uracil
  modified_base 203: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 228: mod_base = OTHER; note = uracil
  modified_base 231: mod_base = OTHER; note = uracil
  modified_base 236: mod_base = OTHER; note = uracil
  modified_base 247: mod_base = OTHER; note = uracil
  modified_base 251: mod_base = OTHER; note = uracil
  modified_base 256: mod_base = OTHER; note = uracil
  modified_base 258: mod_base = OTHER; note = uracil
  modified_base 265: mod_base = OTHER; note = uracil
  modified_base 266: mod_base = OTHER; note = uracil
  modified_base 280: mod_base = OTHER; note = uracil
tgggygtttttgggaagatggttttygggaaagtatagtttttagataggtttygaggtaggagtttgtttgatttatyggaggagtttggaggaggttgaggtggtttaagtygattaagtagggtggggagggaagaggygatggtgtygtgagattaagtagggttttgaggtttggggggagaattttggtttttattttgaggaaggtgggagttatagaggtttttagatagaagaaggataagtyggatttaggatattagggtgggggtatttgtgggggataaagggagaa

SEQ ID NO: 360 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 40: mod_base = OTHER; note = uracil
  modified_base 41: mod_base = OTHER; note = uracil
  modified_base 47: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 63: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 107: mod_base = OTHER; note = uracil
  modified_base 108: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 145: mod_base = OTHER; note = uracil
  modified_base 147: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 189: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 229: mod_base = OTHER; note = uracil
  modified_base 233: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 263: mod_base = OTHER; note = uracil
  modified_base 268: mod_base = OTHER; note = uracil
  modified_base 272: mod_base = OTHER; note = uracil
  modified_base 273: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 297: mod_base = OTHER; note = uracil
  modified_base 298: mod_base = OTHER; note = uracil
  modified_base 299: mod_base = OTHER; note = uracil
ttttttttttattttttatagatatttttattttggtattttgagttyggtttgttttttttttgtttagaagtttttgtggtttttattttttttagagtaaaagttaaagttttttttttagattttaaggttttgtttggttttayggtattatygttttttttttttttattttgtttaatygatttaggttattttagttttttttaagttttttyggtgagttagataggtttttgtttyggggtttgtttaaaggttgtgttttttyggggattatttttttagagaygttta

SEQ ID NO: 361 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 13: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 32: mod_base = OTHER; note = uracil
  modified_base 34: mod_base = OTHER; note = uracil
  modified_base 39: mod_base = OTHER; note = uracil
  modified_base 44: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 55: mod_base = OTHER; note = uracil
  modified_base 70: mod_base = OTHER; note = uracil
  modified_base 77: mod_base = OTHER; note = uracil
  modified_base 80: mod_base = OTHER; note = uracil
  modified_base 91: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 102: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 126: mod_base = OTHER; note = uracil
  modified_base 127: mod_base = OTHER; note = uracil
  modified_base 135: mod_base = OTHER; note = uracil
  modified_base 141: mod_base = OTHER; note = uracil
  modified_base 153: mod_base = OTHER; note = uracil
  modified_base 155: mod_base = OTHER; note = uracil
  modified_base 161: mod_base = OTHER; note = uracil
  modified_base 163: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 196: mod_base = OTHER; note = uracil
  modified_base 206: mod_base = OTHER; note = uracil
  modified_base 211: mod_base = OTHER; note = uracil
  modified_base 215: mod_base = OTHER; note = uracil
  modified_base 217: mod_base = OTHER; note = uracil
  modified_base 223: mod_base = OTHER; note = uracil
  modified_base 227: mod_base = OTHER; note = uracil
  modified_base 232: mod_base = OTHER; note = uracil
  modified_base 236: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 254: mod_base = OTHER; note = uracil
  modified_base 258: mod_base = OTHER; note = uracil
  modified_base 266: mod_base = OTHER; note = uracil
  modified_base 267: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 293: mod_base = OTHER; note = uracil
  modified_base 294: mod_base = OTHER; note = uracil
  modified_base 295: mod_base = OTHER; note = uracil
ggttttgtgaaattaattaggaagaatgaaatatagagttggttygatatttagttygagggaggggggtyggaagtttttggaagttggttgtttttaagtaggggttattttagtttataaggttaagttggtagaggtagaygaggggattttgyggtttaagttaygggttaggagttygtagttgtygggttggaaaggttagagtyggttttgygtttggttgygtyggtaagaagttataattaygtaggtaaaagagttyggggattagttttagtatttgggattttgaat

SEQ ID NO: 362 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 18: mod_base = OTHER; note = uracil
  modified_base 24: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 36: mod_base = OTHER; note = uracil
  modified_base 38: mod_base = OTHER; note = uracil
  modified_base 44: mod_base = OTHER; note = uracil
  modified_base 45: mod_base = OTHER; note = uracil
  modified_base 59: mod_base = OTHER; note = uracil
  modified_base 62: mod_base = OTHER; note = uracil
  modified_base 66: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 82: mod_base = OTHER; note = uracil
  modified_base 87: mod_base = OTHER; note = uracil
  modified_base 91: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 111: mod_base = OTHER; note = uracil
  modified_base 114: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 128: mod_base = OTHER; note = uracil
  modified_base 129: mod_base = OTHER; note = uracil
  modified_base 135: mod_base = OTHER; note = uracil
  modified_base 141: mod_base = OTHER; note = uracil
  modified_base 144: mod_base = OTHER; note = uracil
  modified_base 150: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 161: mod_base = OTHER; note = uracil
  modified_base 162: mod_base = OTHER; note = uracil
  modified_base 164: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 176: mod_base = OTHER; note = uracil
  modified_base 177: mod_base = OTHER; note = uracil
  modified_base 185: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 200: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 225: mod_base = OTHER; note = uracil
  modified_base 228: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 247: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 265: mod_base = OTHER; note = uracil
  modified_base 273: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 292: mod_base = OTHER; note = uracil
  modified_base 294: mod_base = OTHER; note = uracil
  modified_base 299: mod_base = OTHER; note = uracil
  modified_base 300: mod_base = OTHER; note = uracil
atttagggttttaggtgttggggttaattttygggtttttttgtttgygtaattgtggttttttgtyggygtagttagaygtagagtyggttttgatttttttagttyggtagttgygggtttttggttygtgatttgagtygtagagttttttygtttgtttttgttaatttggttttgtgggttagagtggtttttgtttaggggtagttaatttttagaagttttyggtttttttttttygagttgggtgtyggattagttttgtgttttattttttttggttggttttataaagtt

SEQ ID NO: 363 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 21: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 39: mod_base = OTHER; note = uracil
  modified_base 45: mod_base = OTHER; note = uracil
  modified_base 50: mod_base = OTHER; note = uracil
  modified_base 55: mod_base = OTHER; note = uracil
  modified_base 56: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 69: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 83: mod_base = OTHER; note = uracil
  modified_base 91: mod_base = OTHER; note = uracil
  modified_base 105: mod_base = OTHER; note = uracil
  modified_base 107: mod_base = OTHER; note = uracil
  modified_base 111: mod_base = OTHER; note = uracil
  modified_base 112: mod_base = OTHER; note = uracil
  modified_base 120: mod_base = OTHER; note = uracil
  modified_base 124: mod_base = OTHER; note = uracil
  modified_base 126: mod_base = OTHER; note = uracil
  modified_base 134: mod_base = OTHER; note = uracil
  modified_base 138: mod_base = OTHER; note = uracil
  modified_base 142: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 154: mod_base = OTHER; note = uracil
  modified_base 159: mod_base = OTHER; note = uracil
  modified_base 162: mod_base = OTHER; note = uracil
  modified_base 166: mod_base = OTHER; note = uracil
  modified_base 167: mod_base = OTHER; note = uracil
  modified_base 170: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 186: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 208: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 235: mod_base = OTHER; note = uracil
  modified_base 236: mod_base = OTHER; note = uracil
  modified_base 240: mod_base = OTHER; note = uracil
  modified_base 242: mod_base = OTHER; note = uracil
  modified_base 252: mod_base = OTHER; note = uracil
  modified_base 260: mod_base = OTHER; note = uracil
  modified_base 261: mod_base = OTHER; note = uracil
  modified_base 291: mod_base = OTHER; note = uracil
  modified_base 297: mod_base = OTHER; note = uracil
  modified_base 298: mod_base = OTHER; note = uracil
aggttgaayggaattgggagtagagttttgyggtaggatagagatttygtaaagttyggagtatatagtagtatttygttttttaaaggataattttgggaaaatttttgtttaatattttggtattaaggattattttgttatattttygttttggattataagtttgtaagttttattyggggtagggttttttatttttgtgtatygtggaagttttgtgtttgtttagggtttggtatttgtaygtatttgaaaatttygtgtggagtaaagagaggggtgatgtgtaaaggtttt

SEQ ID NO: 364 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 11: mod_base = OTHER; note = uracil
  modified_base 13: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 25: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 46: mod_base = OTHER; note = uracil
  modified_base 56: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 74: mod_base = OTHER; note = uracil
  modified_base 78: mod_base = OTHER; note = uracil
  modified_base 80: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 96: mod_base = OTHER; note = uracil
  modified_base 98: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 128: mod_base = OTHER; note = uracil
  modified_base 132: mod_base = OTHER; note = uracil
  modified_base 136: mod_base = OTHER; note = uracil
  modified_base 144: mod_base = OTHER; note = uracil
  modified_base 145: mod_base = OTHER; note = uracil
  modified_base 161: mod_base = OTHER; note = uracil
  modified_base 170: mod_base = OTHER; note = uracil
  modified_base 171: mod_base = OTHER; note = uracil
  modified_base 178: mod_base = OTHER; note = uracil
  modified_base 179: mod_base = OTHER; note = uracil
  modified_base 191: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 212: mod_base = OTHER; note = uracil
  modified_base 213: mod_base = OTHER; note = uracil
  modified_base 230: mod_base = OTHER; note = uracil
  modified_base 233: mod_base = OTHER; note = uracil
  modified_base 240: mod_base = OTHER; note = uracil
  modified_base 242: mod_base = OTHER; note = uracil
  modified_base 247: mod_base = OTHER; note = uracil
  modified_base 258: mod_base = OTHER; note = uracil
  modified_base 260: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 271: mod_base = OTHER; note = uracil
  modified_base 276: mod_base = OTHER; note = uracil
  modified_base 278: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 285: mod_base = OTHER; note = uracil
  modified_base 290: mod_base = OTHER; note = uracil
  modified_base 295: mod_base = OTHER; note = uracil
  modified_base 298: mod_base = OTHER; note = uracil
  modified_base 299: mod_base = OTHER; note = uracil
aaggtttttgtatattatttttttttttattttataygaggtttttaagtaygtataagtgttaggttttgggtaggtatagggtttttayggtgtataggaatgaggagttttgtttyggatggggtttgtaggtttgtagtttagagyggggatgtgatagaatgatttttagtgttagaatattaggtaagagtttttttaaaattgttttttagaagayggggtgttgttgtgtgtttygggttttgygaagtttttgttttatygtagggttttgtttttaatttygtttagttt

SEQ ID NO: 365 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 41: mod_base = OTHER; note = uracil
  modified_base 79: mod_base = OTHER; note = uracil
  modified_base 84: mod_base = OTHER; note = uracil
  modified_base 86: mod_base = OTHER; note = uracil
  modified_base 93: mod_base = OTHER; note = uracil
  modified_base 116: mod_base = OTHER; note = uracil
  modified_base 132: mod_base = OTHER; note = uracil
  modified_base 133: mod_base = OTHER; note = uracil
  modified_base 137: mod_base = OTHER; note = uracil
  modified_base 143: mod_base = OTHER; note = uracil
  modified_base 147: mod_base = OTHER; note = uracil
  modified_base 150: mod_base = OTHER; note = uracil
  modified_base 156: mod_base = OTHER; note = uracil
  modified_base 160: mod_base = OTHER; note = uracil
  modified_base 166: mod_base = OTHER; note = uracil
  modified_base 182: mod_base = OTHER; note = uracil
  modified_base 188: mod_base = OTHER; note = uracil
  modified_base 195: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 210: mod_base = OTHER; note = uracil
  modified_base 215: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 238: mod_base = OTHER; note = uracil
  modified_base 248: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 261: mod_base = OTHER; note = uracil
  modified_base 270: mod_base = OTHER; note = uracil
  modified_base 281: mod_base = OTHER; note = uracil
  modified_base 284: mod_base = OTHER; note = uracil
  modified_base 285: mod_base = OTHER; note = uracil
  modified_base 294: mod_base = OTHER; note = uracil
  modified_base 297: mod_base = OTHER; note = uracil
agttaggttaaattagygtgttttaatgaggggttttgggttgagtggaggaaatgggtgyggtggaggtgggtttggttgggtatagygggtaygtgtgggtaagygggtggggtyggttgtgygggtggtttatttggggtaagtagtygaggtygattgtgttyggygtgtggttgagtaygggtaggtgtttggyggtgattttgtaygtttggtgtttatttggttttgggtttgaygtgggtygygtttggttgttggygggatagtgtgttatttgtttgyggaygttttygg

SEQ ID NO: 366 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 11: mod_base = OTHER; note = uracil
  modified_base 14: mod_base = OTHER; note = uracil
  modified_base 18: mod_base = OTHER; note = uracil
  modified_base 25: mod_base = OTHER; note = uracil
  modified_base 27: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 72: mod_base = OTHER; note = uracil
  modified_base 73: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 92: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 120: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 132: mod_base = OTHER; note = uracil
  modified_base 137: mod_base = OTHER; note = uracil
  modified_base 139: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 179: mod_base = OTHER; note = uracil
  modified_base 182: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 192: mod_base = OTHER; note = uracil
  modified_base 195: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 281: mod_base = OTHER; note = uracil
  modified_base 285: mod_base = OTHER; note = uracil
  modified_base 294: mod_base = OTHER; note = uracil
  modified_base 295: mod_base = OTHER; note = uracil
  modified_base 299: mod_base = OTHER; note = uracil
tyggaagygttygtaggtagataatatattgtttygttagtagttaggygyggtttaygttagatttagggttaggtaaatattagaygtgtagggttatygttagatatttgttygtgtttaattataygtyggatatagtyggtttyggttgtttgttttagataggttattygtataatyggttttattygtttatttataygtgttygttgtgtttagttaaatttatttttatygtatttattttttttatttagtttagggttttttattgggataygttggtttagtttggtt

SEQ ID NO: 367 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 7: mod_base = OTHER; note = uracil
  modified_base 9: mod_base = OTHER; note = uracil
  modified_base 26: mod_base = OTHER; note = uracil
  modified_base 33: mod_base = OTHER; note = uracil
  modified_base 49: mod_base = OTHER; note = uracil
  modified_base 56: mod_base = OTHER; note = uracil
  modified_base 64: mod_base = OTHER; note = uracil
  modified_base 67: mod_base = OTHER; note = uracil
  modified_base 72: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 86: mod_base = OTHER; note = uracil
  modified_base 93: mod_base = OTHER; note = uracil
  modified_base 101: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 132: mod_base = OTHER; note = uracil
  modified_base 133: mod_base = OTHER; note = uracil
  modified_base 138: mod_base = OTHER; note = uracil
  modified_base 139: mod_base = OTHER; note = uracil
  modified_base 142: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 150: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 162: mod_base = OTHER; note = uracil
  modified_base 164: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 197: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 236: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 265: mod_base = OTHER; note = uracil
  modified_base 267: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ttttggtttaggttggggagggygttatgagttatgaggtgggygttgtatttgttagttgtgtagtygygtattatygagtagtttggyggtagygygttygygttygattgygtttggttygtaggaggttyggtttagtagttttttygtattagggttatyggygygygatattttgggggygggatyggggttygtgttttgtttttygaaatttttttttttttagttttagygtttttttttttttttttatttttttatttttatttatatttttttttttttttttttttt

SEQ ID NO: 368 - DNA, 300 bp, synthetic construct
  misc_feature 1..300: note = Synthetic polynucleotide
  source 1..300: mol_type = other DNA
  modified_base 63: mod_base = OTHER; note = uracil
  modified_base 69: mod_base = OTHER; note = uracil
  modified_base 94: mod_base = OTHER; note = uracil
  modified_base 99: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 134: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 157: mod_base = OTHER; note = uracil
  modified_base 160: mod_base = OTHER; note = uracil
  modified_base 165: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 181: mod_base = OTHER; note = uracil
  modified_base 182: mod_base = OTHER; note = uracil
  modified_base 188: mod_base = OTHER; note = uracil
  modified_base 206: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 217: mod_base = OTHER; note = uracil
  modified_base 220: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 247: mod_base = OTHER; note = uracil
  modified_base 253: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 270: mod_base = OTHER; note = uracil
  modified_base 272: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 290: mod_base = OTHER; note = uracil
  modified_base 295: mod_base = OTHER; note = uracil
  modified_base 296: mod_base = OTHER; note = uracil
gggaaggagggaggggaggaggtgtaggtgaaagtgaaaggatagagggaggaggaagaaygttgagattggagggagaagggtttygggaagtagagtaygagtttygatttygtttttagggtatygygygtyggtgattttggtgyggaagggttgttggatygggttttttgygggttagaygtaatygaaygyggaygygttgtygttagattattyggtggtgygyggttgtataattgataaatgtaaygtttattttatgatttatgaygttttttttaatttgagttaagg

SEQ ID NO: 369 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 13: mod_base = OTHER; note = uracil
  modified_base 25: mod_base = OTHER; note = uracil
  modified_base 30: mod_base = OTHER; note = uracil
  modified_base 32: mod_base = OTHER; note = uracil
  modified_base 34: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 57: mod_base = OTHER; note = uracil
  modified_base 61: mod_base = OTHER; note = uracil
  modified_base 66: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 90: mod_base = OTHER; note = uracil
  modified_base 99: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 117: mod_base = OTHER; note = uracil
  modified_base 118: mod_base = OTHER; note = uracil
  modified_base 122: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 180: mod_base = OTHER; note = uracil
  modified_base 183: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 194: mod_base = OTHER; note = uracil
  modified_base 196: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 229: mod_base = OTHER; note = uracil
  modified_base 239: mod_base = OTHER; note = uracil
  modified_base 249: mod_base = OTHER; note = uracil
  modified_base 254: mod_base = OTHER; note = uracil
  modified_base 258: mod_base = OTHER; note = uracil
  modified_base 296: mod_base = OTHER; note = uracil
  modified_base 298: mod_base = OTHER; note = uracil
taggttggagtgtaatggygygatttyggtttattgtaatttttgtttttygggtttaagtaatttttttattttagttttttgagtagttgggattataggtatttgtygttatgttyggttaattttttaatttgtttttagtagagayggggttttattatgttggttaggtyggtttataatttttgattttaggtgatttattygtttyggttttttaaattataggtgttattattaggatttttggtagataggagtgttgtaggggatggaagtggatagtaggaggttttg

SEQ ID NO: 370 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 10: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 23: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 33: mod_base = OTHER; note = uracil
  modified_base 36: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 45: mod_base = OTHER; note = uracil
  modified_base 48: mod_base = OTHER; note = uracil
  modified_base 49: mod_base = OTHER; note = uracil
  modified_base 56: mod_base = OTHER; note = uracil
  modified_base 57: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 85: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 110: mod_base = OTHER; note = uracil
  modified_base 123: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 154: mod_base = OTHER; note = uracil
  modified_base 157: mod_base = OTHER; note = uracil
  modified_base 164: mod_base = OTHER; note = uracil
  modified_base 180: mod_base = OTHER; note = uracil
  modified_base 185: mod_base = OTHER; note = uracil
  modified_base 193: mod_base = OTHER; note = uracil
  modified_base 199: mod_base = OTHER; note = uracil
  modified_base 200: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 212: mod_base = OTHER; note = uracil
  modified_base 215: mod_base = OTHER; note = uracil
  modified_base 217: mod_base = OTHER; note = uracil
  modified_base 224: mod_base = OTHER; note = uracil
  modified_base 241: mod_base = OTHER; note = uracil
  modified_base 247: mod_base = OTHER; note = uracil
  modified_base 248: mod_base = OTHER; note = uracil
  modified_base 256: mod_base = OTHER; note = uracil
  modified_base 265: mod_base = OTHER; note = uracil
  modified_base 272: mod_base = OTHER; note = uracil
  modified_base 283: mod_base = OTHER; note = uracil
  modified_base 284: mod_base = OTHER; note = uracil
  modified_base 289: mod_base = OTHER; note = uracil
  modified_base 291: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 298: mod_base = OTHER; note = uracil
tagagttttttattatttatttttattttttataatatttttgtttgttaagaattttaatgataatatttgtaatttgggaggtygaggygggtagattatttgagattaggagttgtagatyggtttggttaatatggtgaaatttygtttttattaaaaataaattaaaaaattagtygggtatggyggtaggtatttgtaattttagttatttaggaggttaaggtagaagaattgtttgaattygagaggtagaagttgtagtgagtygagatygygttattgtattttagtttg

SEQ ID NO: 371 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 9: mod_base = OTHER; note = uracil
  modified_base 14: mod_base = OTHER; note = uracil
  modified_base 17: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 28: mod_base = OTHER; note = uracil
  modified_base 33: mod_base = OTHER; note = uracil
  modified_base 37: mod_base = OTHER; note = uracil
  modified_base 43: mod_base = OTHER; note = uracil
  modified_base 48: mod_base = OTHER; note = uracil
  modified_base 52: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 75: mod_base = OTHER; note = uracil
  modified_base 77: mod_base = OTHER; note = uracil
  modified_base 84: mod_base = OTHER; note = uracil
  modified_base 88: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 117: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 127: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 139: mod_base = OTHER; note = uracil
  modified_base 141: mod_base = OTHER; note = uracil
  modified_base 143: mod_base = OTHER; note = uracil
  modified_base 147: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 159: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 179: mod_base = OTHER; note = uracil
  modified_base 181: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 201: mod_base = OTHER; note = uracil
  modified_base 202: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 219: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 233: mod_base = OTHER; note = uracil
  modified_base 237: mod_base = OTHER; note = uracil
  modified_base 238: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 255: mod_base = OTHER; note = uracil
  modified_base 258: mod_base = OTHER; note = uracil
  modified_base 264: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 286: mod_base = OTHER; note = uracil
  modified_base 287: mod_base = OTHER; note = uracil
tgaatgatttgggtagtatttttttatttgygtttgtatttgttagatagtttgtgattttttgtgggagaaaatataagaaatyggtttttttgttggttttttatttggtttggtttttttgttttttattttgtatatttatgtttyggaatttgttttttttttgagttttttttatagtggttyggtttaygtggtttttaatttgtttatattagagtttttattttyggtttatggtttattagaggtagttggagtygggtattttttttaygtgggtttttgaggatggga

SEQ ID NO: 372 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 33: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 58: mod_base = OTHER; note = uracil
  modified_base 59: mod_base = OTHER; note = uracil
  modified_base 65: mod_base = OTHER; note = uracil
  modified_base 78: mod_base = OTHER; note = uracil
  modified_base 80: mod_base = OTHER; note = uracil
  modified_base 90: mod_base = OTHER; note = uracil
  modified_base 101: mod_base = OTHER; note = uracil
  modified_base 102: mod_base = OTHER; note = uracil
  modified_base 110: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 130: mod_base = OTHER; note = uracil
  modified_base 132: mod_base = OTHER; note = uracil
  modified_base 143: mod_base = OTHER; note = uracil
  modified_base 149: mod_base = OTHER; note = uracil
  modified_base 155: mod_base = OTHER; note = uracil
  modified_base 165: mod_base = OTHER; note = uracil
  modified_base 177: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 214: mod_base = OTHER; note = uracil
  modified_base 221: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 245: mod_base = OTHER; note = uracil
  modified_base 247: mod_base = OTHER; note = uracil
  modified_base 251: mod_base = OTHER; note = uracil
  modified_base 255: mod_base = OTHER; note = uracil
  modified_base 259: mod_base = OTHER; note = uracil
  modified_base 265: mod_base = OTHER; note = uracil
  modified_base 271: mod_base = OTHER; note = uracil
  modified_base 285: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 295: mod_base = OTHER; note = uracil
  modified_base 299: mod_base = OTHER; note = uracil
ttttatttttaaaggtttaygtggggaggatgttyggttttagttgtttttgatgggttataggtyggaggtggaggttttgatgtgggtagattaaaggttaygtgggtygggttattgtgagggaggtttagaggagaagtaggtttygaggtatgagtgtgtagggtggagaataggagagttaggttaggtggggaattagtagaggggtyggttttttgtgtttttttttatagagagttatagattgtttagtaaatgtaagygtaggtggagaaatgttgtttaggttattta

SEQ ID NO: 373 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 19: mod_base = OTHER; note = uracil
  modified_base 32: mod_base = OTHER; note = uracil
  modified_base 41: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 80: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 103: mod_base = OTHER; note = uracil
  modified_base 114: mod_base = OTHER; note = uracil
  modified_base 115: mod_base = OTHER; note = uracil
  modified_base 126: mod_base = OTHER; note = uracil
  modified_base 130: mod_base = OTHER; note = uracil
  modified_base 135: mod_base = OTHER; note = uracil
  modified_base 140: mod_base = OTHER; note = uracil
  modified_base 142: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 168: mod_base = OTHER; note = uracil
  modified_base 172: mod_base = OTHER; note = uracil
  modified_base 176: mod_base = OTHER; note = uracil
  modified_base 179: mod_base = OTHER; note = uracil
  modified_base 184: mod_base = OTHER; note = uracil
  modified_base 187: mod_base = OTHER; note = uracil
  modified_base 191: mod_base = OTHER; note = uracil
  modified_base 198: mod_base = OTHER; note = uracil
  modified_base 205: mod_base = OTHER; note = uracil
  modified_base 207: mod_base = OTHER; note = uracil
  modified_base 210: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 242: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 262: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 295: mod_base = OTHER; note = uracil
  modified_base 298: mod_base = OTHER; note = uracil
  modified_base 299: mod_base = OTHER; note = uracil
gggyggggtttgtgyggtttgyggygyggagtygagtgggttgyggggatgygggggattagttgygtgggyggyggygtygagagtttyggaggygyggggttgagygagggttygygggggygttggttgygtttggtttyggtatgygtttattttttttgygtttygttagttgtygtgttgttygtygtgtattayggttttatttgggtatttaygyggtttttygyggtattygtyggtttatagtttagygygtygtttttttygtgtgttgttygttygggygtgtygttt

SEQ ID NO: 374 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 11: mod_base = OTHER; note = uracil
  modified_base 12: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 44: mod_base = OTHER; note = uracil
  modified_base 49: mod_base = OTHER; note = uracil
  modified_base 56: mod_base = OTHER; note = uracil
  modified_base 66: mod_base = OTHER; note = uracil
  modified_base 76: mod_base = OTHER; note = uracil
  modified_base 87: mod_base = OTHER; note = uracil
  modified_base 88: mod_base = OTHER; note = uracil
  modified_base 89: mod_base = OTHER; note = uracil
  modified_base 98: mod_base = OTHER; note = uracil
  modified_base 106: mod_base = OTHER; note = uracil
  modified_base 115: mod_base = OTHER; note = uracil
  modified_base 118: mod_base = OTHER; note = uracil
  modified_base 123: mod_base = OTHER; note = uracil
  modified_base 126: mod_base = OTHER; note = uracil
  modified_base 137: mod_base = OTHER; note = uracil
  modified_base 152: mod_base = OTHER; note = uracil
  modified_base 156: mod_base = OTHER; note = uracil
  modified_base 162: mod_base = OTHER; note = uracil
  modified_base 163: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 194: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 215: mod_base = OTHER; note = uracil
  modified_base 217: mod_base = OTHER; note = uracil
  modified_base 224: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 236: mod_base = OTHER; note = uracil
  modified_base 239: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 280: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 298: mod_base = OTHER; note = uracil
  modified_base 299: mod_base = OTHER; note = uracil
  modified_base 300: mod_base = OTHER; note = uracil
aggyggtaygttygggygggtagtatayggaggggayggygygttgggttgtgggtyggygggtgtygygggagatygygtgggtatttagatgagatygtagtatayggygagtagtayggtagttagygagaygtagaggaagtaggygtatatyggagttaagygtagttagygttttygygggttttygtttagtttygygttttyggggttttyggygtygtygtttaygtagttggtttttygtattttygtagtttattyggtttygygtygtagatygtataggtttygttt

SEQ ID NO: 375 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 35: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 49: mod_base = OTHER; note = uracil
  modified_base 67: mod_base = OTHER; note = uracil
  modified_base 76: mod_base = OTHER; note = uracil
  modified_base 80: mod_base = OTHER; note = uracil
  modified_base 84: mod_base = OTHER; note = uracil
  modified_base 88: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 104: mod_base = OTHER; note = uracil
  modified_base 107: mod_base = OTHER; note = uracil
  modified_base 109: mod_base = OTHER; note = uracil
  modified_base 117: mod_base = OTHER; note = uracil
  modified_base 121: mod_base = OTHER; note = uracil
  modified_base 124: mod_base = OTHER; note = uracil
  modified_base 129: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 148: mod_base = OTHER; note = uracil
  modified_base 151: mod_base = OTHER; note = uracil
  modified_base 157: mod_base = OTHER; note = uracil
  modified_base 158: mod_base = OTHER; note = uracil
  modified_base 161: mod_base = OTHER; note = uracil
  modified_base 168: mod_base = OTHER; note = uracil
  modified_base 178: mod_base = OTHER; note = uracil
  modified_base 183: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 211: mod_base = OTHER; note = uracil
  modified_base 216: mod_base = OTHER; note = uracil
  modified_base 222: mod_base = OTHER; note = uracil
  modified_base 223: mod_base = OTHER; note = uracil
  modified_base 227: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 243: mod_base = OTHER; note = uracil
  modified_base 251: mod_base = OTHER; note = uracil
  modified_base 259: mod_base = OTHER; note = uracil
  modified_base 266: mod_base = OTHER; note = uracil
  modified_base 275: mod_base = OTHER; note = uracil
  modified_base 283: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 297: mod_base = OTHER; note = uracil
  modified_base 299: mod_base = OTHER; note = uracil
aagtgtatttttaaggtatgaggggtttagaggatattgttttaaaagtagtggttgtgagagtggttttggagttaggttgatagtttggaaatttttaggttygttttgaagtgtyggttgtatgattagttttttagtttgtgttygtttyggttttttttgtgtaagtgagagtattgttgattttttyggggtggygagggggygtaygttagtgatttygtatggtgtttgttaggtaygtggttygtgttttatgattttttgagagttttggagtagttttaagaagatttt

SEQ ID NO: 376 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 8: mod_base = OTHER; note = uracil
  modified_base 15: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 26: mod_base = OTHER; note = uracil
  modified_base 28: mod_base = OTHER; note = uracil
  modified_base 30: mod_base = OTHER; note = uracil
  modified_base 38: mod_base = OTHER; note = uracil
  modified_base 45: mod_base = OTHER; note = uracil
  modified_base 51: mod_base = OTHER; note = uracil
  modified_base 52: mod_base = OTHER; note = uracil
  modified_base 58: mod_base = OTHER; note = uracil
  modified_base 59: mod_base = OTHER; note = uracil
  modified_base 63: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 80: mod_base = OTHER; note = uracil
  modified_base 82: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 115: mod_base = OTHER; note = uracil
  modified_base 118: mod_base = OTHER; note = uracil
  modified_base 123: mod_base = OTHER; note = uracil
  modified_base 125: mod_base = OTHER; note = uracil
  modified_base 127: mod_base = OTHER; note = uracil
  modified_base 129: mod_base = OTHER; note = uracil
  modified_base 133: mod_base = OTHER; note = uracil
  modified_base 135: mod_base = OTHER; note = uracil
  modified_base 144: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 168: mod_base = OTHER; note = uracil
  modified_base 173: mod_base = OTHER; note = uracil
  modified_base 177: mod_base = OTHER; note = uracil
  modified_base 180: mod_base = OTHER; note = uracil
  modified_base 184: mod_base = OTHER; note = uracil
  modified_base 186: mod_base = OTHER; note = uracil
  modified_base 189: mod_base = OTHER; note = uracil
  modified_base 198: mod_base = OTHER; note = uracil
  modified_base 199: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 218: mod_base = OTHER; note = uracil
  modified_base 221: mod_base = OTHER; note = uracil
  modified_base 222: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 249: mod_base = OTHER; note = uracil
  modified_base 252: mod_base = OTHER; note = uracil
  modified_base 261: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 284: mod_base = OTHER; note = uracil
  modified_base 285: mod_base = OTHER; note = uracil
  modified_base 295: mod_base = OTHER; note = uracil
  modified_base 297: mod_base = OTHER; note = uracil
gagtttttttggagttgttttaaagtttttaaagaattatgaaatayggattaygtgtttggtaggtattatgygaggttattgaygtgygttttttygttatttyggggggattagtaatgtttttatttgtataaagaaggtygaagyggatataggttggagggttggttatgtagtyggtattttagagyggatttggaagtttttagattgttagtttgattttaaagttatttttataattattgtttttgggatagtgttttttgggttttttatattttgaaaatatatttt

SEQ ID NO: 377 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 16: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 27: mod_base = OTHER; note = uracil
  modified_base 30: mod_base = OTHER; note = uracil
  modified_base 53: mod_base = OTHER; note = uracil
  modified_base 54: mod_base = OTHER; note = uracil
  modified_base 67: mod_base = OTHER; note = uracil
  modified_base 70: mod_base = OTHER; note = uracil
  modified_base 72: mod_base = OTHER; note = uracil
  modified_base 77: mod_base = OTHER; note = uracil
  modified_base 80: mod_base = OTHER; note = uracil
  modified_base 84: mod_base = OTHER; note = uracil
  modified_base 93: mod_base = OTHER; note = uracil
  modified_base 96: mod_base = OTHER; note = uracil
  modified_base 106: mod_base = OTHER; note = uracil
  modified_base 114: mod_base = OTHER; note = uracil
  modified_base 121: mod_base = OTHER; note = uracil
  modified_base 128: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 143: mod_base = OTHER; note = uracil
  modified_base 162: mod_base = OTHER; note = uracil
  modified_base 165: mod_base = OTHER; note = uracil
  modified_base 169: mod_base = OTHER; note = uracil
  modified_base 172: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 225: mod_base = OTHER; note = uracil
  modified_base 233: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 271: mod_base = OTHER; note = uracil
  modified_base 272: mod_base = OTHER; note = uracil
  modified_base 278: mod_base = OTHER; note = uracil
  modified_base 279: mod_base = OTHER; note = uracil
  modified_base 287: mod_base = OTHER; note = uracil
  modified_base 288: mod_base = OTHER; note = uracil
  modified_base 292: mod_base = OTHER; note = uracil
  modified_base 297: mod_base = OTHER; note = uracil
  modified_base 298: mod_base = OTHER; note = uracil
  modified_base 299: mod_base = OTHER; note = uracil
taattttaaataaaattttttatgagtaattaaatatttaaaatgtgtttttttataaaagtgaattagtttagttttgtaggttgaaaatataataaggaggattygggttgtagaaagtagagggttatttagatygtgtttgagagayggggagaaagtagttgtttgttgtgtattagaggtttttagggatttyggtagtaatttygtggygggttatatttgggagttgatttgtttttagaattattagttaagttatatgagttaggagtttggttatttatttaaagttta

SEQ ID NO: 378 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 19: mod_base = OTHER; note = uracil
  modified_base 20: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 31: mod_base = OTHER; note = uracil
  modified_base 33: mod_base = OTHER; note = uracil
  modified_base 40: mod_base = OTHER; note = uracil
  modified_base 45: mod_base = OTHER; note = uracil
  modified_base 54: mod_base = OTHER; note = uracil
  modified_base 61: mod_base = OTHER; note = uracil
  modified_base 66: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 97: mod_base = OTHER; note = uracil
  modified_base 100: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 116: mod_base = OTHER; note = uracil
  modified_base 117: mod_base = OTHER; note = uracil
  modified_base 119: mod_base = OTHER; note = uracil
  modified_base 125: mod_base = OTHER; note = uracil
  modified_base 127: mod_base = OTHER; note = uracil
  modified_base 130: mod_base = OTHER; note = uracil
  modified_base 134: mod_base = OTHER; note = uracil
  modified_base 137: mod_base = OTHER; note = uracil
  modified_base 140: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 166: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 181: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 222: mod_base = OTHER; note = uracil
  modified_base 227: mod_base = OTHER; note = uracil
  modified_base 232: mod_base = OTHER; note = uracil
  modified_base 238: mod_base = OTHER; note = uracil
  modified_base 240: mod_base = OTHER; note = uracil
  modified_base 254: mod_base = OTHER; note = uracil
  modified_base 256: mod_base = OTHER; note = uracil
  modified_base 275: mod_base = OTHER; note = uracil
  modified_base 277: mod_base = OTHER; note = uracil
tgggttttgaatggataattaggtttttggtttatgtggtttagttggtggttttgaaaataaattagtttttaagtgtggttygttayggggttgttgtyggggtttttagaggtttttggtgtatagtagatagttgtttttttttygttttttagatayggtttaggtggttttttgttttttgtaattyggattttttttgttgtatttttagtttgtagaattgagttgatttatttttatggaaaaatatattttaaatatttagttgtttatggagagttttgtttaaaatta

SEQ ID NO: 379 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 11: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 30: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 60: mod_base = OTHER; note = uracil
  modified_base 61: mod_base = OTHER; note = uracil
  modified_base 63: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 77: mod_base = OTHER; note = uracil
  modified_base 82: mod_base = OTHER; note = uracil
  modified_base 89: mod_base = OTHER; note = uracil
  modified_base 93: mod_base = OTHER; note = uracil
  modified_base 95: mod_base = OTHER; note = uracil
  modified_base 98: mod_base = OTHER; note = uracil
  modified_base 106: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 117: mod_base = OTHER; note = uracil
  modified_base 119: mod_base = OTHER; note = uracil
  modified_base 121: mod_base = OTHER; note = uracil
  modified_base 124: mod_base = OTHER; note = uracil
  modified_base 131: mod_base = OTHER; note = uracil
  modified_base 136: mod_base = OTHER; note = uracil
  modified_base 140: mod_base = OTHER; note = uracil
  modified_base 146: mod_base = OTHER; note = uracil
  modified_base 147: mod_base = OTHER; note = uracil
  modified_base 150: mod_base = OTHER; note = uracil
  modified_base 162: mod_base = OTHER; note = uracil
  modified_base 166: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 203: mod_base = OTHER; note = uracil
  modified_base 213: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 236: mod_base = OTHER; note = uracil
  modified_base 239: mod_base = OTHER; note = uracil
  modified_base 241: mod_base = OTHER; note = uracil
  modified_base 244: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 270: mod_base = OTHER; note = uracil
  modified_base 272: mod_base = OTHER; note = uracil
  modified_base 274: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 292: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 299: mod_base = OTHER; note = uracil
  modified_base 300: mod_base = OTHER; note = uracil
gtttttagattygaaattttttattgaagttatttttaggaggaggggttttattggggttttaaggtagtattagtattttyggtgataggtatagtaatttattagtttattggttttttattgagaataaggtaagtyggggtttgtygagggtatgataggtagggagtgatgggttyggtttagggtaggagggagatagaaatgggtaggaagaggaggttgtttttagtagtatttttgagaggaggagtatttttyggggatattttggayggtatttttaagtatagtttt

SEQ ID NO: 380 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 10: mod_base = OTHER; note = uracil
  modified_base 20: mod_base = OTHER; note = uracil
  modified_base 24: mod_base = OTHER; note = uracil
  modified_base 25: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 55: mod_base = OTHER; note = uracil
  modified_base 63: mod_base = OTHER; note = uracil
  modified_base 66: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 117: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 162: mod_base = OTHER; note = uracil
  modified_base 166: mod_base = OTHER; note = uracil
  modified_base 167: mod_base = OTHER; note = uracil
  modified_base 173: mod_base = OTHER; note = uracil
  modified_base 175: mod_base = OTHER; note = uracil
  modified_base 185: mod_base = OTHER; note = uracil
  modified_base 186: mod_base = OTHER; note = uracil
  modified_base 193: mod_base = OTHER; note = uracil
  modified_base 204: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 216: mod_base = OTHER; note = uracil
  modified_base 225: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 272: mod_base = OTHER; note = uracil
  modified_base 275: mod_base = OTHER; note = uracil
  modified_base 293: mod_base = OTHER; note = uracil
  modified_base 300: mod_base = OTHER; note = uracil
ggggttgtgtttgggggtgtygtttagagtgttttygaaaggtgtttttttttttagaagtgttgttggggatagttttttttttttgtttatttttgttttttttttgttttgggtygggtttattattttttgtttgttatattttyggtaggtttyggtttgttttgtttttagtagagagttagtgagttgataaattgttgtgtttgttatyggaaatgttgatgttgttttgaggttttagtgaggtttttttttttgggaatggttttagtgggggatttygggtttggaggt

SEQ ID NO: 381 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 10: mod_base = OTHER; note = uracil
  modified_base 11: mod_base = OTHER; note = uracil
  modified_base 15: mod_base = OTHER; note = uracil
  modified_base 26: mod_base = OTHER; note = uracil
  modified_base 44: mod_base = OTHER; note = uracil
  modified_base 56: mod_base = OTHER; note = uracil
  modified_base 66: mod_base = OTHER; note = uracil
  modified_base 68: mod_base = OTHER; note = uracil
  modified_base 70: mod_base = OTHER; note = uracil
  modified_base 82: mod_base = OTHER; note = uracil
  modified_base 85: mod_base = OTHER; note = uracil
  modified_base 94: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 108: mod_base = OTHER; note = uracil
  modified_base 110: mod_base = OTHER; note = uracil
  modified_base 112: mod_base = OTHER; note = uracil
  modified_base 119: mod_base = OTHER; note = uracil
  modified_base 121: mod_base = OTHER; note = uracil
  modified_base 125: mod_base = OTHER; note = uracil
  modified_base 126: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 153: mod_base = OTHER; note = uracil
  modified_base 160: mod_base = OTHER; note = uracil
  modified_base 163: mod_base = OTHER; note = uracil
  modified_base 164: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 183: mod_base = OTHER; note = uracil
  modified_base 204: mod_base = OTHER; note = uracil
  modified_base 210: mod_base = OTHER; note = uracil
  modified_base 211: mod_base = OTHER; note = uracil
  modified_base 220: mod_base = OTHER; note = uracil
  modified_base 239: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 260: mod_base = OTHER; note = uracil
  modified_base 261: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 281: mod_base = OTHER; note = uracil
  modified_base 284: mod_base = OTHER; note = uracil
  modified_base 293: mod_base = OTHER; note = uracil
  modified_base 295: mod_base = OTHER; note = uracil
tgagagtagttagataygtagtgattagggaaagtygaaagtgtagatgggttygtaaaygtggattttttagttttgggtttgtagatggggtyggttattaygtgttttttgagttttttttttaagtatagattttttyggagayggaatattgtttygtttttaattttttttaggagttgyggaggaaggygtgagaatyggagttyggggtgatttgygggggaggggatygttttttygtygtttatatttgtttaatttaygtttayggyggtygtaaaggygatatygygt

SEQ ID NO: 382 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 13: mod_base = OTHER; note = uracil
  modified_base 21: mod_base = OTHER; note = uracil
  modified_base 24: mod_base = OTHER; note = uracil
  modified_base 42: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 94: mod_base = OTHER; note = uracil
  modified_base 100: mod_base = OTHER; note = uracil
  modified_base 102: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 116: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 144: mod_base = OTHER; note = uracil
  modified_base 151: mod_base = OTHER; note = uracil
  modified_base 155: mod_base = OTHER; note = uracil
  modified_base 157: mod_base = OTHER; note = uracil
  modified_base 167: mod_base = OTHER; note = uracil
  modified_base 172: mod_base = OTHER; note = uracil
  modified_base 185: mod_base = OTHER; note = uracil
  modified_base 187: mod_base = OTHER; note = uracil
  modified_base 194: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 214: mod_base = OTHER; note = uracil
  modified_base 217: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 228: mod_base = OTHER; note = uracil
  modified_base 237: mod_base = OTHER; note = uracil
  modified_base 238: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 258: mod_base = OTHER; note = uracil
  modified_base 260: mod_base = OTHER; note = uracil
  modified_base 267: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 278: mod_base = OTHER; note = uracil
  modified_base 280: mod_base = OTHER; note = uracil
  modified_base 288: mod_base = OTHER; note = uracil
  modified_base 292: mod_base = OTHER; note = uracil
  modified_base 295: mod_base = OTHER; note = uracil
  modified_base 297: mod_base = OTHER; note = uracil
  modified_base 299: mod_base = OTHER; note = uracil
aygyggtgtygtttttgyggtygtygtgggygtgggttaggtaggtgtgggygayggggaagygattttttttttygtaagttatttygggtttyggtttttaygttttttttygtagtttttgggaagaattaaaggyggaataatgtttygttttyggagggatttgtatttggaaagagaatttagagagtaygtggtggtyggttttatttgtagatttaaaattagagagtttaygtttgygaatttatttgtattttygattttttttgattattaygtgtttggttgttttta

SEQ ID NO: 383 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 25: mod_base = OTHER; note = uracil
  modified_base 28: mod_base = OTHER; note = uracil
  modified_base 34: mod_base = OTHER; note = uracil
  modified_base 39: mod_base = OTHER; note = uracil
  modified_base 45: mod_base = OTHER; note = uracil
  modified_base 50: mod_base = OTHER; note = uracil
  modified_base 56: mod_base = OTHER; note = uracil
  modified_base 58: mod_base = OTHER; note = uracil
  modified_base 64: mod_base = OTHER; note = uracil
  modified_base 68: mod_base = OTHER; note = uracil
  modified_base 70: mod_base = OTHER; note = uracil
  modified_base 74: mod_base = OTHER; note = uracil
  modified_base 78: mod_base = OTHER; note = uracil
  modified_base 82: mod_base = OTHER; note = uracil
  modified_base 87: mod_base = OTHER; note = uracil
  modified_base 93: mod_base = OTHER; note = uracil
  modified_base 97: mod_base = OTHER; note = uracil
  modified_base 102: mod_base = OTHER; note = uracil
  modified_base 112: mod_base = OTHER; note = uracil
  modified_base 113: mod_base = OTHER; note = uracil
  modified_base 118: mod_base = OTHER; note = uracil
  modified_base 122: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 201: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 212: mod_base = OTHER; note = uracil
  modified_base 220: mod_base = OTHER; note = uracil
  modified_base 221: mod_base = OTHER; note = uracil
  modified_base 225: mod_base = OTHER; note = uracil
  modified_base 227: mod_base = OTHER; note = uracil
  modified_base 229: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 252: mod_base = OTHER; note = uracil
  modified_base 253: mod_base = OTHER; note = uracil
  modified_base 258: mod_base = OTHER; note = uracil
  modified_base 261: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 275: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 291: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ataagyggttggatttygagaggatattaagagtaygttaagagtaygttaagagtatayggataggtattggtaygtyggtaggttattgatyggtagaatagagtttggttagggttgttagagaagagtygggtygttaagtagttygatttttagyggaaaattatttgttttttggtttttttatttgttgagagttatttttatttaataaaattttgtatttattttttaaatttatatgagatttaattttttyggtatattaaggtaggaatttygagatatagaaagttt

SEQ ID NO: 384 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 8: mod_base = OTHER; note = uracil
  modified_base 14: mod_base = OTHER; note = uracil
  modified_base 23: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 37: mod_base = OTHER; note = uracil
  modified_base 52: mod_base = OTHER; note = uracil
  modified_base 54: mod_base = OTHER; note = uracil
  modified_base 77: mod_base = OTHER; note = uracil
  modified_base 101: mod_base = OTHER; note = uracil
  modified_base 103: mod_base = OTHER; note = uracil
  modified_base 105: mod_base = OTHER; note = uracil
  modified_base 108: mod_base = OTHER; note = uracil
  modified_base 120: mod_base = OTHER; note = uracil
  modified_base 121: mod_base = OTHER; note = uracil
  modified_base 128: mod_base = OTHER; note = uracil
  modified_base 139: mod_base = OTHER; note = uracil
  modified_base 142: mod_base = OTHER; note = uracil
  modified_base 154: mod_base = OTHER; note = uracil
  modified_base 157: mod_base = OTHER; note = uracil
  modified_base 165: mod_base = OTHER; note = uracil
  modified_base 166: mod_base = OTHER; note = uracil
  modified_base 170: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 197: mod_base = OTHER; note = uracil
  modified_base 202: mod_base = OTHER; note = uracil
  modified_base 205: mod_base = OTHER; note = uracil
  modified_base 210: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 228: mod_base = OTHER; note = uracil
  modified_base 229: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 246: mod_base = OTHER; note = uracil
  modified_base 248: mod_base = OTHER; note = uracil
  modified_base 257: mod_base = OTHER; note = uracil
  modified_base 259: mod_base = OTHER; note = uracil
  modified_base 268: mod_base = OTHER; note = uracil
  modified_base 270: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 289: mod_base = OTHER; note = uracil
  modified_base 290: mod_base = OTHER; note = uracil
  modified_base 293: mod_base = OTHER; note = uracil
  modified_base 296: mod_base = OTHER; note = uracil
gggttttttgtatttyggggtttttgttttggtgtatyggaagaattggattttatgtgggtttggagaatgagtgtaaggttttattgagtggaagtagtttttagtagatggaggagttagaaggtagatggtttttygttggaagtygggttgtttggyggttygatttttttttgatagttttggttaaattttgttttgtyggttaatgatttgtyggygtgttagtgtttgttygtgtgtttttgaygtgtttttgaygtgtttttgatgttttttygaaatttaatygtttgt

SEQ ID NO: 385 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 10: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 76: mod_base = OTHER; note = uracil
  modified_base 92: mod_base = OTHER; note = uracil
  modified_base 93: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 105: mod_base = OTHER; note = uracil
  modified_base 107: mod_base = OTHER; note = uracil
  modified_base 117: mod_base = OTHER; note = uracil
  modified_base 132: mod_base = OTHER; note = uracil
  modified_base 134: mod_base = OTHER; note = uracil
  modified_base 142: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 168: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 184: mod_base = OTHER; note = uracil
  modified_base 186: mod_base = OTHER; note = uracil
  modified_base 189: mod_base = OTHER; note = uracil
  modified_base 196: mod_base = OTHER; note = uracil
  modified_base 198: mod_base = OTHER; note = uracil
  modified_base 208: mod_base = OTHER; note = uracil
  modified_base 227: mod_base = OTHER; note = uracil
  modified_base 228: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 240: mod_base = OTHER; note = uracil
  modified_base 243: mod_base = OTHER; note = uracil
  modified_base 245: mod_base = OTHER; note = uracil
  modified_base 252: mod_base = OTHER; note = uracil
  modified_base 258: mod_base = OTHER; note = uracil
  modified_base 267: mod_base = OTHER; note = uracil
  modified_base 269: mod_base = OTHER; note = uracil
  modified_base 275: mod_base = OTHER; note = uracil
  modified_base 284: mod_base = OTHER; note = uracil
  modified_base 293: mod_base = OTHER; note = uracil
atttgaagttaggagttygtgaatagtttggttaatatggtgaaattttgtttttattaaaaaaagaaaaattagtygggtgtggtgggygtttgtaattttagtattttgggaggttgaggtgggtggattatttgaagttaggagttygtgaatagtttgattaatatggtgaaattttgtttttattaaaaatataaaaattagtygggtgtggtggtgggtgtttgtaattttagttatttaggagattgaggtaggaggattatttgaatyggggaggtagaggttgtagagagt

SEQ ID NO: 386 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 8: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 28: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 61: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 118: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 138: mod_base = OTHER; note = uracil
  modified_base 142: mod_base = OTHER; note = uracil
  modified_base 147: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 160: mod_base = OTHER; note = uracil
  modified_base 163: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 196: mod_base = OTHER; note = uracil
  modified_base 205: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 225: mod_base = OTHER; note = uracil
  modified_base 234: mod_base = OTHER; note = uracil
  modified_base 250: mod_base = OTHER; note = uracil
  modified_base 258: mod_base = OTHER; note = uracil
  modified_base 260: mod_base = OTHER; note = uracil
  modified_base 261: mod_base = OTHER; note = uracil
  modified_base 269: mod_base = OTHER; note = uracil
  modified_base 270: mod_base = OTHER; note = uracil
  modified_base 274: mod_base = OTHER; note = uracil
  modified_base 279: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 292: mod_base = OTHER; note = uracil
  modified_base 295: mod_base = OTHER; note = uracil
ttttttgtaatttttgttttttyggtttaagtgatttttttgttttagttttttgagtagttgggattataggtatttattattatattyggttaatttttgtgtttttagtagagatagggttttattatgttgattaggttgtttaygaatttttgattttaagtgatttatttattttagttttttaaagtgttggggttataggygtttattatattyggttaatttttttttttttagtagagatagggttttattatgttggttaggttgtttaygaatttttgattttaagtg

SEQ ID NO: 387 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 11: mod_base = OTHER; note = uracil
  modified_base 12: mod_base = OTHER; note = uracil
  modified_base 15: mod_base = OTHER; note = uracil
  modified_base 16: mod_base = OTHER; note = uracil
  modified_base 19: mod_base = OTHER; note = uracil
  modified_base 25: mod_base = OTHER; note = uracil
  modified_base 29: mod_base = OTHER; note = uracil
  modified_base 36: mod_base = OTHER; note = uracil
  modified_base 40: mod_base = OTHER; note = uracil
  modified_base 43: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 58: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 100: mod_base = OTHER; note = uracil
  modified_base 104: mod_base = OTHER; note = uracil
  modified_base 110: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 142: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 197: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 210: mod_base = OTHER; note = uracil
  modified_base 217: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 229: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 249: mod_base = OTHER; note = uracil
  modified_base 254: mod_base = OTHER; note = uracil
  modified_base 257: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 275: mod_base = OTHER; note = uracil
  modified_base 284: mod_base = OTHER; note = uracil
  modified_base 286: mod_base = OTHER; note = uracil
  modified_base 297: mod_base = OTHER; note = uracil
  modified_base 298: mod_base = OTHER; note = uracil
aaattttttttttgtttgtatttttttatataaagtaatttattattgttatyggtttatttatttatyggaatttgttttgttaggatttgattttagtagattgagttatattagtattatttttgttggggtttaggtttgtatttygttttyggttttagttttattgttagttttattaggttttttggggtatattaaggaggtygttttttttttttttttttgaattagatttttagaaataagatattaggttttttggggaaatttaattttgtttatgaatttgattat

SEQ ID NO: 388 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 12: mod_base = OTHER; note = uracil
  modified_base 18: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 41: mod_base = OTHER; note = uracil
  modified_base 42: mod_base = OTHER; note = uracil
  modified_base 49: mod_base = OTHER; note = uracil
  modified_base 56: mod_base = OTHER; note = uracil
  modified_base 64: mod_base = OTHER; note = uracil
  modified_base 70: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 96: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 115: mod_base = OTHER; note = uracil
  modified_base 116: mod_base = OTHER; note = uracil
  modified_base 125: mod_base = OTHER; note = uracil
  modified_base 129: mod_base = OTHER; note = uracil
  modified_base 137: mod_base = OTHER; note = uracil
  modified_base 143: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 167: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 184: mod_base = OTHER; note = uracil
  modified_base 193: mod_base = OTHER; note = uracil
  modified_base 195: mod_base = OTHER; note = uracil
  modified_base 199: mod_base = OTHER; note = uracil
  modified_base 202: mod_base = OTHER; note = uracil
  modified_base 209: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 224: mod_base = OTHER; note = uracil
  modified_base 230: mod_base = OTHER; note = uracil
  modified_base 246: mod_base = OTHER; note = uracil
  modified_base 253: mod_base = OTHER; note = uracil
  modified_base 266: mod_base = OTHER; note = uracil
  modified_base 283: mod_base = OTHER; note = uracil
  modified_base 287: mod_base = OTHER; note = uracil
atggttaaatttatgagtaaaattagatttttttaggaagtttgatgttttgtttttggggatttaatttagaaaaagggagagaaaayggtttttttggtgtgttttagaggatttgatggagttaatagtggggttggggtyggaagygggatgtagatttgggttttaataaggatgatgttggtatgatttagtttgttgaggttaggttttggtaagataggtttyggtgagtgaatgaatygatggtagtagtagattgttttatgtaagaaaatgtaggtaggaaaaagattt

SEQ ID NO: 389 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 18: mod_base = OTHER; note = uracil
  modified_base 19: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 29: mod_base = OTHER; note = uracil
  modified_base 32: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 43: mod_base = OTHER; note = uracil
  modified_base 48: mod_base = OTHER; note = uracil
  modified_base 49: mod_base = OTHER; note = uracil
  modified_base 61: mod_base = OTHER; note = uracil
  modified_base 62: mod_base = OTHER; note = uracil
  modified_base 66: mod_base = OTHER; note = uracil
  modified_base 72: mod_base = OTHER; note = uracil
  modified_base 73: mod_base = OTHER; note = uracil
  modified_base 104: mod_base = OTHER; note = uracil
  modified_base 105: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 150: mod_base = OTHER; note = uracil
  modified_base 153: mod_base = OTHER; note = uracil
  modified_base 166: mod_base = OTHER; note = uracil
  modified_base 170: mod_base = OTHER; note = uracil
  modified_base 176: mod_base = OTHER; note = uracil
  modified_base 185: mod_base = OTHER; note = uracil
  modified_base 193: mod_base = OTHER; note = uracil
  modified_base 230: mod_base = OTHER; note = uracil
  modified_base 234: mod_base = OTHER; note = uracil
  modified_base 237: mod_base = OTHER; note = uracil
  modified_base 240: mod_base = OTHER; note = uracil
  modified_base 248: mod_base = OTHER; note = uracil
  modified_base 249: mod_base = OTHER; note = uracil
  modified_base 256: mod_base = OTHER; note = uracil
  modified_base 266: mod_base = OTHER; note = uracil
  modified_base 268: mod_base = OTHER; note = uracil
  modified_base 279: mod_base = OTHER; note = uracil
  modified_base 285: mod_base = OTHER; note = uracil
  modified_base 288: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 300: mod_base = OTHER; note = uracil
taaggtttaggttttagtttttttatygtygttygygtttttttaggtttyggagyggygtttttttgyggtttygaaggtggggtgggaaagtttggggagtttyggtttttatagtttgtygtgagaattgttttyggggaattygttygtygtayggaaaaattggtyggagtagagtygttygyggtttygyggtygygggtggaaggtgaaggtygagggaggttaggttgtttttgygtgttttgayggttggygtgtttttttgagatgggttygggttatttggttagtttt

SEQ ID NO: 390 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 10: mod_base = OTHER; note = uracil
  modified_base 17: mod_base = OTHER; note = uracil
  modified_base 18: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 28: mod_base = OTHER; note = uracil
  modified_base 30: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 50: mod_base = OTHER; note = uracil
  modified_base 55: mod_base = OTHER; note = uracil
  modified_base 59: mod_base = OTHER; note = uracil
  modified_base 65: mod_base = OTHER; note = uracil
  modified_base 68: mod_base = OTHER; note = uracil
  modified_base 69: mod_base = OTHER; note = uracil
  modified_base 73: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 103: mod_base = OTHER; note = uracil
  modified_base 111: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 128: mod_base = OTHER; note = uracil
  modified_base 132: mod_base = OTHER; note = uracil
  modified_base 133: mod_base = OTHER; note = uracil
  modified_base 141: mod_base = OTHER; note = uracil
  modified_base 159: mod_base = OTHER; note = uracil
  modified_base 160: mod_base = OTHER; note = uracil
  modified_base 161: mod_base = OTHER; note = uracil
  modified_base 168: mod_base = OTHER; note = uracil
  modified_base 173: mod_base = OTHER; note = uracil
  modified_base 175: mod_base = OTHER; note = uracil
  modified_base 180: mod_base = OTHER; note = uracil
  modified_base 184: mod_base = OTHER; note = uracil
  modified_base 193: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 230: mod_base = OTHER; note = uracil
  modified_base 233: mod_base = OTHER; note = uracil
  modified_base 243: mod_base = OTHER; note = uracil
  modified_base 246: mod_base = OTHER; note = uracil
  modified_base 248: mod_base = OTHER; note = uracil
  modified_base 254: mod_base = OTHER; note = uracil
  modified_base 255: mod_base = OTHER; note = uracil
  modified_base 284: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 297: mod_base = OTHER; note = uracil
gaagttggttaagtagttygagtttattttaagagaataygttagtygttaggataygtagaagtagtttgatttttttygatttttattttttattygygatygyggaatygyggaygattttgtttyggttagttttttygtayggyggaygaatttttygggggtagtttttaygataggttgtgagagtygggattttttaaatttttttattttattttygaggtygtagaaaggygtygtttygaggtttaggagggygygggyggyggtggggaggttgggatttggattttg

SEQ ID NO: 391 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 10: mod_base = OTHER; note = uracil
  modified_base 11: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 21: mod_base = OTHER; note = uracil
  modified_base 25: mod_base = OTHER; note = uracil
  modified_base 33: mod_base = OTHER; note = uracil
  modified_base 43: mod_base = OTHER; note = uracil
  modified_base 60: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 91: mod_base = OTHER; note = uracil
  modified_base 95: mod_base = OTHER; note = uracil
  modified_base 108: mod_base = OTHER; note = uracil
  modified_base 109: mod_base = OTHER; note = uracil
  modified_base 114: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 144: mod_base = OTHER; note = uracil
  modified_base 147: mod_base = OTHER; note = uracil
  modified_base 148: mod_base = OTHER; note = uracil
  modified_base 150: mod_base = OTHER; note = uracil
  modified_base 166: mod_base = OTHER; note = uracil
  modified_base 167: mod_base = OTHER; note = uracil
  modified_base 172: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 190: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 214: mod_base = OTHER; note = uracil
  modified_base 220: mod_base = OTHER; note = uracil
  modified_base 226: mod_base = OTHER; note = uracil
  modified_base 232: mod_base = OTHER; note = uracil
  modified_base 235: mod_base = OTHER; note = uracil
  modified_base 243: mod_base = OTHER; note = uracil
  modified_base 249: mod_base = OTHER; note = uracil
  modified_base 253: mod_base = OTHER; note = uracil
  modified_base 259: mod_base = OTHER; note = uracil
  modified_base 264: mod_base = OTHER; note = uracil
  modified_base 268: mod_base = OTHER; note = uracil
  modified_base 271: mod_base = OTHER; note = uracil
  modified_base 280: mod_base = OTHER; note = uracil
  modified_base 284: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 298: mod_base = OTHER; note = uracil
tygagggagttaggttatagttgataggaaggtagaaggtggtaggaggggaggttgygttgtatttttgggttgtttaggttaatttgttaggtaggagggggaagttygtgtttattttattatgatygggaagatgatggtagttatygtggatttgaggatttagagtatygttaggtagaggatttgtattagggtgaagaggtggattyggygtagyggtaygtgtygtaggaaggtatggttyggttggtgtttggttggtattaggaagagtttgtagygtttttagaatta

SEQ ID NO: 392 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 15: mod_base = OTHER; note = uracil
  modified_base 18: mod_base = OTHER; note = uracil
  modified_base 22: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 70: mod_base = OTHER; note = uracil
  modified_base 76: mod_base = OTHER; note = uracil
  modified_base 79: mod_base = OTHER; note = uracil
  modified_base 84: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 109: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 130: mod_base = OTHER; note = uracil
  modified_base 132: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 146: mod_base = OTHER; note = uracil
  modified_base 147: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 174: mod_base = OTHER; note = uracil
  modified_base 188: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 220: mod_base = OTHER; note = uracil
  modified_base 221: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 239: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 278: mod_base = OTHER; note = uracil
  modified_base 281: mod_base = OTHER; note = uracil
  modified_base 287: mod_base = OTHER; note = uracil
  modified_base 288: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 296: mod_base = OTHER; note = uracil
tagttttgggaaygttgtaagttttttttgatgttagttaagtattagtyggattatgtttttttgyggtaygtgtygttgygtyggatttatttttttattttggtgtagattttttgtttggyggtgttttggatttttaaatttayggtggttgttattattttttyggttatggtaaagtgggtaygggttttttttttttgtttggtaggttggtttgggtaatttagaggtgtagygtaatttttttttttgttattttttgtttttttgttagttgtggtttggttttttygg

SEQ ID NO: 393 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 27: mod_base = OTHER; note = uracil
  modified_base 28: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 45: mod_base = OTHER; note = uracil
  modified_base 52: mod_base = OTHER; note = uracil
  modified_base 58: mod_base = OTHER; note = uracil
  modified_base 66: mod_base = OTHER; note = uracil
  modified_base 69: mod_base = OTHER; note = uracil
  modified_base 75: mod_base = OTHER; note = uracil
  modified_base 76: mod_base = OTHER; note = uracil
  modified_base 84: mod_base = OTHER; note = uracil
  modified_base 89: mod_base = OTHER; note = uracil
  modified_base 115: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 128: mod_base = OTHER; note = uracil
  modified_base 132: mod_base = OTHER; note = uracil
  modified_base 136: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 173: mod_base = OTHER; note = uracil
  modified_base 174: mod_base = OTHER; note = uracil
  modified_base 183: mod_base = OTHER; note = uracil
  modified_base 186: mod_base = OTHER; note = uracil
  modified_base 189: mod_base = OTHER; note = uracil
  modified_base 201: mod_base = OTHER; note = uracil
  modified_base 202: mod_base = OTHER; note = uracil
  modified_base 206: mod_base = OTHER; note = uracil
  modified_base 211: mod_base = OTHER; note = uracil
  modified_base 219: mod_base = OTHER; note = uracil
  modified_base 220: mod_base = OTHER; note = uracil
  modified_base 229: mod_base = OTHER; note = uracil
  modified_base 232: mod_base = OTHER; note = uracil
  modified_base 237: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 270: mod_base = OTHER; note = uracil
  modified_base 274: mod_base = OTHER; note = uracil
  modified_base 278: mod_base = OTHER; note = uracil
  modified_base 288: mod_base = OTHER; note = uracil
  modified_base 289: mod_base = OTHER; note = uracil
  modified_base 299: mod_base = OTHER; note = uracil
aaattattygggygtggtggtgggtgtttgtaattttagttatttaggaggtygaggtaggagaatygtttgaattygggaggtagagtataggttgttggagggttgaaggtgtatttagtagagattggtatataggaggttttgtaayggttttaggaaatttttgggtttagtaagagttttagtaggaggtagaattatatygggtaggagtgtttggaaaggttttaaggtaattttttttaaagttttggtttaattttatattgttaggttgttaaaggttatttaaaagtt

SEQ ID NO: 394 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 14: mod_base = OTHER; note = uracil
  modified_base 15: mod_base = OTHER; note = uracil
  modified_base 21: mod_base = OTHER; note = uracil
  modified_base 24: mod_base = OTHER; note = uracil
  modified_base 25: mod_base = OTHER; note = uracil
  modified_base 29: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 65: mod_base = OTHER; note = uracil
  modified_base 66: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 85: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 113: mod_base = OTHER; note = uracil
  modified_base 119: mod_base = OTHER; note = uracil
  modified_base 121: mod_base = OTHER; note = uracil
  modified_base 125: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 141: mod_base = OTHER; note = uracil
  modified_base 142: mod_base = OTHER; note = uracil
  modified_base 148: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 177: mod_base = OTHER; note = uracil
  modified_base 180: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 213: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 229: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 262: mod_base = OTHER; note = uracil
  modified_base 271: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 289: mod_base = OTHER; note = uracil
  modified_base 290: mod_base = OTHER; note = uracil
agtttttaaatggtttttaatagtttgatagtgtagggttgggttaggattttggagggagttgttttgaagtttttttaggtatttttgttyggtatggttttattttttgttgaagtttttattggatttagaggttttttggggtygttgtaggattttttgtatgttagtttttgttgggtgtatttttaattttttaataatttatgttttgtttttygggtttaagyggtttttttgtttyggttttttgagtagttgggattataggtatttattattaygttygggtaattt

SEQ ID NO: 395 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 13: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 29: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 40: mod_base = OTHER; note = uracil
  modified_base 43: mod_base = OTHER; note = uracil
  modified_base 52: mod_base = OTHER; note = uracil
  modified_base 55: mod_base = OTHER; note = uracil
  modified_base 74: mod_base = OTHER; note = uracil
  modified_base 81: mod_base = OTHER; note = uracil
  modified_base 83: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 112: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 135: mod_base = OTHER; note = uracil
  modified_base 151: mod_base = OTHER; note = uracil
  modified_base 153: mod_base = OTHER; note = uracil
  modified_base 156: mod_base = OTHER; note = uracil
  modified_base 158: mod_base = OTHER; note = uracil
  modified_base 161: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 182: mod_base = OTHER; note = uracil
  modified_base 183: mod_base = OTHER; note = uracil
  modified_base 192: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 207: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 248: mod_base = OTHER; note = uracil
  modified_base 259: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 278: mod_base = OTHER; note = uracil
  modified_base 280: mod_base = OTHER; note = uracil
  modified_base 282: mod_base = OTHER; note = uracil
  modified_base 283: mod_base = OTHER; note = uracil
  modified_base 287: mod_base = OTHER; note = uracil
  modified_base 288: mod_base = OTHER; note = uracil
  modified_base 290: mod_base = OTHER; note = uracil
aggaaaaaatagtagtttaagaatygggtttttttgttatagtaggagtygtatttatttatatatgttatgttttattgtttagtaattagttttyggtyggggygtgggtygggaagaggggttttttggtgtagygggttggygtgatttattatygtygygtattttggtttttgggtttaggttaatagattttygggttttaggttgggtttaggyggttaggttttttttgttgaggaatttgggttggggtagtgttagttttttgttttttatttggttatagaaggggta

SEQ ID NO: 396 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 9: mod_base = OTHER; note = uracil
  modified_base 15: mod_base = OTHER; note = uracil
  modified_base 16: mod_base = OTHER; note = uracil
  modified_base 27: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 63: mod_base = OTHER; note = uracil
  modified_base 72: mod_base = OTHER; note = uracil
  modified_base 73: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 98: mod_base = OTHER; note = uracil
  modified_base 99: mod_base = OTHER; note = uracil
  modified_base 107: mod_base = OTHER; note = uracil
  modified_base 114: mod_base = OTHER; note = uracil
  modified_base 115: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 128: mod_base = OTHER; note = uracil
  modified_base 129: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 209: mod_base = OTHER; note = uracil
  modified_base 216: mod_base = OTHER; note = uracil
  modified_base 221: mod_base = OTHER; note = uracil
  modified_base 229: mod_base = OTHER; note = uracil
  modified_base 234: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 265: mod_base = OTHER; note = uracil
  modified_base 273: mod_base = OTHER; note = uracil
  modified_base 274: mod_base = OTHER; note = uracil
  modified_base 280: mod_base = OTHER; note = uracil
  modified_base 286: mod_base = OTHER; note = uracil
  modified_base 289: mod_base = OTHER; note = uracil
  modified_base 298: mod_base = OTHER; note = uracil
  modified_base 299: mod_base = OTHER; note = uracil
tattttttttgtggttaggtgagaagtagggagttggtattgttttaatttagattttttagtagggagggtttggtygtttgggtttagtttgaaattygggagtttgttaatttaggtttagaggttagagtgygyggyggtgatgagttaygttaattygttgtattaggagattttttttttyggtttaygtttyggtygagagttggttgttgagtaataagatataatatatataaatagatgygatttttgttgtaatagggaggttygatttttgggttgttgttttttttt

SEQ ID NO: 397 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 12: mod_base = OTHER; note = uracil
  modified_base 39: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 53: mod_base = OTHER; note = uracil
  modified_base 61: mod_base = OTHER; note = uracil
  modified_base 69: mod_base = OTHER; note = uracil
  modified_base 73: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 85: mod_base = OTHER; note = uracil
  modified_base 89: mod_base = OTHER; note = uracil
  modified_base 91: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 104: mod_base = OTHER; note = uracil
  modified_base 108: mod_base = OTHER; note = uracil
  modified_base 109: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 137: mod_base = OTHER; note = uracil
  modified_base 143: mod_base = OTHER; note = uracil
  modified_base 146: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 164: mod_base = OTHER; note = uracil
  modified_base 165: mod_base = OTHER; note = uracil
  modified_base 169: mod_base = OTHER; note = uracil
  modified_base 170: mod_base = OTHER; note = uracil
  modified_base 203: mod_base = OTHER; note = uracil
  modified_base 205: mod_base = OTHER; note = uracil
  modified_base 214: mod_base = OTHER; note = uracil
  modified_base 215: mod_base = OTHER; note = uracil
  modified_base 224: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 237: mod_base = OTHER; note = uracil
  modified_base 238: mod_base = OTHER; note = uracil
  modified_base 246: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 259: mod_base = OTHER; note = uracil
  modified_base 260: mod_base = OTHER; note = uracil
  modified_base 262: mod_base = OTHER; note = uracil
  modified_base 264: mod_base = OTHER; note = uracil
  modified_base 271: mod_base = OTHER; note = uracil
  modified_base 280: mod_base = OTHER; note = uracil
  modified_base 284: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 298: mod_base = OTHER; note = uracil
  modified_base 299: mod_base = OTHER; note = uracil
  modified_base 300: mod_base = OTHER; note = uracil
atttaggaatttttttttttttttttttgagayggygtttttgtygtttaggttggagtgtagtggygtagtttygtttaattgtaagtttygttttygggtttatgttatttttttgttttagttttttgagtagttggaattataggygtttgttattatattyggttaattttttgtatttttagtagagayggggttttatygtgttagttaggatggtttygattttttgatttygtgatttatttattttagttttttaaagtgttgggattataggtttgaattattgygttt

SEQ ID NO: 398 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 31: mod_base = OTHER; note = uracil
  modified_base 33: mod_base = OTHER; note = uracil
  modified_base 43: mod_base = OTHER; note = uracil
  modified_base 58: mod_base = OTHER; note = uracil
  modified_base 66: mod_base = OTHER; note = uracil
  modified_base 79: mod_base = OTHER; note = uracil
  modified_base 80: mod_base = OTHER; note = uracil
  modified_base 83: mod_base = OTHER; note = uracil
  modified_base 84: mod_base = OTHER; note = uracil
  modified_base 88: mod_base = OTHER; note = uracil
  modified_base 92: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 110: mod_base = OTHER; note = uracil
  modified_base 113: mod_base = OTHER; note = uracil
  modified_base 122: mod_base = OTHER; note = uracil
  modified_base 133: mod_base = OTHER; note = uracil
  modified_base 146: mod_base = OTHER; note = uracil
  modified_base 152: mod_base = OTHER; note = uracil
  modified_base 153: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 168: mod_base = OTHER; note = uracil
  modified_base 170: mod_base = OTHER; note = uracil
  modified_base 177: mod_base = OTHER; note = uracil
  modified_base 183: mod_base = OTHER; note = uracil
  modified_base 194: mod_base = OTHER; note = uracil
  modified_base 200: mod_base = OTHER; note = uracil
  modified_base 201: mod_base = OTHER; note = uracil
  modified_base 213: mod_base = OTHER; note = uracil
  modified_base 217: mod_base = OTHER; note = uracil
  modified_base 230: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 258: mod_base = OTHER; note = uracil
  modified_base 266: mod_base = OTHER; note = uracil
  modified_base 270: mod_base = OTHER; note = uracil
  modified_base 272: mod_base = OTHER; note = uracil
  modified_base 294: mod_base = OTHER; note = uracil
  modified_base 295: mod_base = OTHER; note = uracil
gggygtagtggtttaagtttgtaattttagtattttgagaggttgaggtgggtggattaygaggttaggagatygagattattttggttaatayggtgaaatttygtttttattaaaaatataaaaaattggtygggtgtggtggtaggygtttgtagttttagttatttaagaggttgaggtaggagaatggtatgaattygggggyggagtttgtagttaggygagattgygttattgtattttagtttgggygatagagaygtygttttaaaaaaaaaaaaaaaagaatttttgggt

SEQ ID NO: 399 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 30: mod_base = OTHER; note = uracil
  modified_base 31: mod_base = OTHER; note = uracil
  modified_base 39: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 63: mod_base = OTHER; note = uracil
  modified_base 66: mod_base = OTHER; note = uracil
  modified_base 69: mod_base = OTHER; note = uracil
  modified_base 72: mod_base = OTHER; note = uracil
  modified_base 78: mod_base = OTHER; note = uracil
  modified_base 79: mod_base = OTHER; note = uracil
  modified_base 94: mod_base = OTHER; note = uracil
  modified_base 97: mod_base = OTHER; note = uracil
  modified_base 102: mod_base = OTHER; note = uracil
  modified_base 108: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 125: mod_base = OTHER; note = uracil
  modified_base 129: mod_base = OTHER; note = uracil
  modified_base 130: mod_base = OTHER; note = uracil
  modified_base 138: mod_base = OTHER; note = uracil
  modified_base 140: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 154: mod_base = OTHER; note = uracil
  modified_base 157: mod_base = OTHER; note = uracil
  modified_base 176: mod_base = OTHER; note = uracil
  modified_base 180: mod_base = OTHER; note = uracil
  modified_base 183: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 223: mod_base = OTHER; note = uracil
  modified_base 224: mod_base = OTHER; note = uracil
  modified_base 229: mod_base = OTHER; note = uracil
  modified_base 231: mod_base = OTHER; note = uracil
  modified_base 235: mod_base = OTHER; note = uracil
  modified_base 236: mod_base = OTHER; note = uracil
  modified_base 244: mod_base = OTHER; note = uracil
  modified_base 246: mod_base = OTHER; note = uracil
  modified_base 259: mod_base = OTHER; note = uracil
  modified_base 265: mod_base = OTHER; note = uracil
  modified_base 267: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 292: mod_base = OTHER; note = uracil
  modified_base 293: mod_base = OTHER; note = uracil
aaatatagtaggagagaatttttttgagatttaagatatygtgttttttttttttggttttttagttgttgtygagttttggagaaaatygggtatttgaatagaggtygtgtttgtttttgtttyggttttgtgtttttatttttgttaygttattatggataatgaaagttgattggttgtyggggttttttttttttttgtttttgttatttttatttgttaggttttatgttttttttgtatagagttgttgtgtttgggttttaatttgttaggtagtgataaattttaagaaaa

SEQ ID NO: 400 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 17: mod_base = OTHER; note = uracil
  modified_base 19: mod_base = OTHER; note = uracil
  modified_base 22: mod_base = OTHER; note = uracil
  modified_base 23: mod_base = OTHER; note = uracil
  modified_base 27: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 43: mod_base = OTHER; note = uracil
  modified_base 45: mod_base = OTHER; note = uracil
  modified_base 48: mod_base = OTHER; note = uracil
  modified_base 51: mod_base = OTHER; note = uracil
  modified_base 53: mod_base = OTHER; note = uracil
  modified_base 58: mod_base = OTHER; note = uracil
  modified_base 67: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 92: mod_base = OTHER; note = uracil
  modified_base 98: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 127: mod_base = OTHER; note = uracil
  modified_base 130: mod_base = OTHER; note = uracil
  modified_base 134: mod_base = OTHER; note = uracil
  modified_base 140: mod_base = OTHER; note = uracil
  modified_base 141: mod_base = OTHER; note = uracil
  modified_base 154: mod_base = OTHER; note = uracil
  modified_base 166: mod_base = OTHER; note = uracil
  modified_base 168: mod_base = OTHER; note = uracil
  modified_base 173: mod_base = OTHER; note = uracil
  modified_base 179: mod_base = OTHER; note = uracil
  modified_base 185: mod_base = OTHER; note = uracil
  modified_base 189: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 202: mod_base = OTHER; note = uracil
  modified_base 208: mod_base = OTHER; note = uracil
  modified_base 209: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 225: mod_base = OTHER; note = uracil
  modified_base 230: mod_base = OTHER; note = uracil
  modified_base 233: mod_base = OTHER; note = uracil
  modified_base 236: mod_base = OTHER; note = uracil
  modified_base 244: mod_base = OTHER; note = uracil
  modified_base 245: mod_base = OTHER; note = uracil
  modified_base 258: mod_base = OTHER; note = uracil
  modified_base 266: mod_base = OTHER; note = uracil
  modified_base 273: mod_base = OTHER; note = uracil
  modified_base 275: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 293: mod_base = OTHER; note = uracil
tttttttggaatttattattgtttggtaaattagagtttaagtataataattttgtgtaaaaaaggtatgagatttggtaaatggaaatgataggggtagagagaaaggaaatttyggtagttagttaatttttattatttatgatggygtggtaggaatgagaatataaggtyggagtagggataaatayggtttttgtttagatgttygattttttttaggattyggtagtagttgagaggttaagggggaagggtayggtattttaggttttagaggaatttttttttgttgtattt

SEQ ID NO: 401 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 10: mod_base = OTHER; note = uracil
  modified_base 12: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 65: mod_base = OTHER; note = uracil
  modified_base 71: mod_base = OTHER; note = uracil
  modified_base 75: mod_base = OTHER; note = uracil
  modified_base 77: mod_base = OTHER; note = uracil
  modified_base 81: mod_base = OTHER; note = uracil
  modified_base 83: mod_base = OTHER; note = uracil
  modified_base 86: mod_base = OTHER; note = uracil
  modified_base 90: mod_base = OTHER; note = uracil
  modified_base 98: mod_base = OTHER; note = uracil
  modified_base 99: mod_base = OTHER; note = uracil
  modified_base 103: mod_base = OTHER; note = uracil
  modified_base 105: mod_base = OTHER; note = uracil
  modified_base 109: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 152: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 165: mod_base = OTHER; note = uracil
  modified_base 170: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 198: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 212: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 245: mod_base = OTHER; note = uracil
  modified_base 247: mod_base = OTHER; note = uracil
  modified_base 268: mod_base = OTHER; note = uracil
  modified_base 269: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 295: mod_base = OTHER; note = uracil
  modified_base 296: mod_base = OTHER; note = uracil
gttttgagatattaaatggygggggggtggggggaggaaagggaaggyggtagagtttttygagtygggatagttatttattttataggtagtggggttygatatagatagygtygttttygttagttagtttygtaygttttyggaagygtaggttttyggygttgygttggagggtttttyggtattttagtttttygtttttagttygttgtattttygggttttttttatttttgagaggtatygggagttgtygygggggggtttygggaaatttttyggatttttgtgttagga

SEQ ID NO: 402 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 7: mod_base = OTHER; note = uracil
  modified_base 9: mod_base = OTHER; note = uracil
  modified_base 16: mod_base = OTHER; note = uracil
  modified_base 27: mod_base = OTHER; note = uracil
  modified_base 28: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 45: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 77: mod_base = OTHER; note = uracil
  modified_base 78: mod_base = OTHER; note = uracil
  modified_base 87: mod_base = OTHER; note = uracil
  modified_base 94: mod_base = OTHER; note = uracil
  modified_base 108: mod_base = OTHER; note = uracil
  modified_base 116: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 134: mod_base = OTHER; note = uracil
  modified_base 139: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 155: mod_base = OTHER; note = uracil
  modified_base 171: mod_base = OTHER; note = uracil
  modified_base 175: mod_base = OTHER; note = uracil
  modified_base 190: mod_base = OTHER; note = uracil
  modified_base 194: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 228: mod_base = OTHER; note = uracil
  modified_base 232: mod_base = OTHER; note = uracil
  modified_base 233: mod_base = OTHER; note = uracil
  modified_base 237: mod_base = OTHER; note = uracil
  modified_base 246: mod_base = OTHER; note = uracil
  modified_base 248: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 293: mod_base = OTHER; note = uracil
  modified_base 295: mod_base = OTHER; note = uracil
  modified_base 300: mod_base = OTHER; note = uracil
ttttggtataggggttyggggaatttttygaggttttttygygataattttyggtgttttttaagggtaaggggggttyggaggtgtagygggttggggaygggaggttggggtgtyggggaattttttagygtagygtygggagtttgygttttygagggygtgygaggttggttggygggggyggygttgtttgtgtygggttttattgtttgtagagtaagtgattgtttyggttyggggagttttgtygtttttttttttttttttttattttttygttatttagtgttttagggt

SEQ ID NO: 403 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 5: mod_base = OTHER; note = uracil
  modified_base 8: mod_base = OTHER; note = uracil
  modified_base 10: mod_base = OTHER; note = uracil
  modified_base 13: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 31: mod_base = OTHER; note = uracil
  modified_base 43: mod_base = OTHER; note = uracil
  modified_base 47: mod_base = OTHER; note = uracil
  modified_base 49: mod_base = OTHER; note = uracil
  modified_base 51: mod_base = OTHER; note = uracil
  modified_base 72: mod_base = OTHER; note = uracil
  modified_base 93: mod_base = OTHER; note = uracil
  modified_base 99: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 117: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 128: mod_base = OTHER; note = uracil
  modified_base 136: mod_base = OTHER; note = uracil
  modified_base 137: mod_base = OTHER; note = uracil
  modified_base 143: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 174: mod_base = OTHER; note = uracil
  modified_base 198: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 251: mod_base = OTHER; note = uracil
  modified_base 267: mod_base = OTHER; note = uracil
  modified_base 269: mod_base = OTHER; note = uracil
  modified_base 288: mod_base = OTHER; note = uracil
  modified_base 295: mod_base = OTHER; note = uracil
  modified_base 298: mod_base = OTHER; note = uracil
  modified_base 299: mod_base = OTHER; note = uracil
attatagtattgtaggaggatgagtttttgtaggaaggaatgttggttttttggggtagataaagaaggttttggggaagggaagggaggaataggaatatgggttttttgttaggttgttttaggttygggatgttatyggtaagtgggyggggataggtttgggtagatgatatggtagtgagtaagtggggaggtaggttagtagaggagttaggtttatttttygttygtttatttyggttatagatygggaggggtyggagtattgygttggggttgatgagtagaygattgtta

SEQ ID NO: 404 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 11: mod_base = OTHER; note = uracil
  modified_base 14: mod_base = OTHER; note = uracil
  modified_base 16: mod_base = OTHER; note = uracil
  modified_base 19: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 30: mod_base = OTHER; note = uracil
  modified_base 35: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 52: mod_base = OTHER; note = uracil
  modified_base 58: mod_base = OTHER; note = uracil
  modified_base 83: mod_base = OTHER; note = uracil
  modified_base 84: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 116: mod_base = OTHER; note = uracil
  modified_base 118: mod_base = OTHER; note = uracil
  modified_base 120: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 159: mod_base = OTHER; note = uracil
  modified_base 166: mod_base = OTHER; note = uracil
  modified_base 169: mod_base = OTHER; note = uracil
  modified_base 170: mod_base = OTHER; note = uracil
  modified_base 175: mod_base = OTHER; note = uracil
  modified_base 176: mod_base = OTHER; note = uracil
  modified_base 182: mod_base = OTHER; note = uracil
  modified_base 185: mod_base = OTHER; note = uracil
  modified_base 186: mod_base = OTHER; note = uracil
  modified_base 190: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 232: mod_base = OTHER; note = uracil
  modified_base 233: mod_base = OTHER; note = uracil
  modified_base 236: mod_base = OTHER; note = uracil
  modified_base 242: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 263: mod_base = OTHER; note = uracil
  modified_base 264: mod_base = OTHER; note = uracil
  modified_base 267: mod_base = OTHER; note = uracil
  modified_base 268: mod_base = OTHER; note = uracil
  modified_base 271: mod_base = OTHER; note = uracil
  modified_base 277: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 294: mod_base = OTHER; note = uracil
tggtagtygtttgtttattaattttaaygtagtgtttygatttttttyggtttgtggtygaggtgggygggygggaggtgagtttggtttttttgttggtttgtttttttatttatttattattatgttatttatttaggtttgttttygtttatttgtygatggtatttyggatttgggatagtttggtagggagtttatgtttttgtttttttttttttttttttagaattttttttatttattttagagagttagtatttttttttgtaggggtttatttttttgtagtgttgtggt

SEQ ID NO: 405 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 21: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 58: mod_base = OTHER; note = uracil
  modified_base 59: mod_base = OTHER; note = uracil
  modified_base 65: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 96: mod_base = OTHER; note = uracil
  modified_base 120: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 173: mod_base = OTHER; note = uracil
  modified_base 189: mod_base = OTHER; note = uracil
  modified_base 191: mod_base = OTHER; note = uracil
  modified_base 210: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 233: mod_base = OTHER; note = uracil
  modified_base 235: mod_base = OTHER; note = uracil
  modified_base 245: mod_base = OTHER; note = uracil
  modified_base 247: mod_base = OTHER; note = uracil
  modified_base 253: mod_base = OTHER; note = uracil
  modified_base 255: mod_base = OTHER; note = uracil
  modified_base 262: mod_base = OTHER; note = uracil
  modified_base 263: mod_base = OTHER; note = uracil
  modified_base 266: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 290: mod_base = OTHER; note = uracil
agggaagggaggaataggaatatgggttttttgttaggttgttttaggttygggatgttatyggtaagtgggyggggataggtttgggtagatgatatggtagtgagtaagtggggaggtaggttagtagaggagttaggtttatttttygttygtttatttyggttatagatygggaggggtyggagtattgygttggggttgatgagtagaygattgttaggtagttatttataggaaatggtatagaygtatattgttttagttattttttatttttttttaggggtaaagtgaatg

SEQ ID NO: 406 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 35: mod_base = OTHER; note = uracil
  modified_base 41: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 62: mod_base = OTHER; note = uracil
  modified_base 63: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 81: mod_base = OTHER; note = uracil
  modified_base 88: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 107: mod_base = OTHER; note = uracil
  modified_base 112: mod_base = OTHER; note = uracil
  modified_base 114: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 135: mod_base = OTHER; note = uracil
  modified_base 160: mod_base = OTHER; note = uracil
  modified_base 161: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 193: mod_base = OTHER; note = uracil
  modified_base 195: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 209: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 236: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 253: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 267: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 282: mod_base = OTHER; note = uracil
  modified_base 283: mod_base = OTHER; note = uracil
  modified_base 288: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 296: mod_base = OTHER; note = uracil
  modified_base 297: mod_base = OTHER; note = uracil
  modified_base 298: mod_base = OTHER; note = uracil
atttattttgtttttgagggaggatggggggtagttggaataatgtgygtttgtgttattttttgtgaatggttgtttggtagtygtttgtttattaattttaaygtagtgtttygatttttttyggtttgtggtygaggtgggygggygggaggtgagtttggtttttttgttggtttgtttttttatttatttattattatgttatttatttaggtttgttttygtttatttgtygatggtatttyggatttgggatagtttggtagggagtttatgtttttgttttttttttttttt

SEQ ID NO: 407 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 10: mod_base = OTHER; note = uracil
  modified_base 12: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 27: mod_base = OTHER; note = uracil
  modified_base 30: mod_base = OTHER; note = uracil
  modified_base 40: mod_base = OTHER; note = uracil
  modified_base 41: mod_base = OTHER; note = uracil
  modified_base 49: mod_base = OTHER; note = uracil
  modified_base 50: mod_base = OTHER; note = uracil
  modified_base 54: mod_base = OTHER; note = uracil
  modified_base 64: mod_base = OTHER; note = uracil
  modified_base 70: mod_base = OTHER; note = uracil
  modified_base 72: mod_base = OTHER; note = uracil
  modified_base 90: mod_base = OTHER; note = uracil
  modified_base 101: mod_base = OTHER; note = uracil
  modified_base 103: mod_base = OTHER; note = uracil
  modified_base 116: mod_base = OTHER; note = uracil
  modified_base 121: mod_base = OTHER; note = uracil
  modified_base 133: mod_base = OTHER; note = uracil
  modified_base 136: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 148: mod_base = OTHER; note = uracil
  modified_base 157: mod_base = OTHER; note = uracil
  modified_base 160: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 173: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 184: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 210: mod_base = OTHER; note = uracil
  modified_base 212: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 230: mod_base = OTHER; note = uracil
  modified_base 232: mod_base = OTHER; note = uracil
  modified_base 236: mod_base = OTHER; note = uracil
  modified_base 242: mod_base = OTHER; note = uracil
  modified_base 250: mod_base = OTHER; note = uracil
  modified_base 256: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 270: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 292: mod_base = OTHER; note = uracil
ggttttaaatatataaatttttgatgtatttggaatttattttaattttttagtaatttttattaatggtttaatatttgggggatttttatggtaattgtattgaatgtattaattggttagggaggattatattaagattatyggttygagaaatagtagtttgtttttttatttttaygtttgtatttaggtttttttatagagattttattttttttgtagatgatttatttagtgtttaggaattyggtgttttgtggttattatygagagtgggatatttttttttattttatt

SEQ ID NO: 408 - DNA, 300 bp, synthetic construct
  misc_feature 1..300: note = Synthetic polynucleotide
  source 1..300: mol_type = other DNA
  modified_base 21: mod_base = OTHER; note = uracil
  modified_base 22: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 46: mod_base = OTHER; note = uracil
  modified_base 48: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 63: mod_base = OTHER; note = uracil
  modified_base 73: mod_base = OTHER; note = uracil
  modified_base 76: mod_base = OTHER; note = uracil
  modified_base 79: mod_base = OTHER; note = uracil
  modified_base 94: mod_base = OTHER; note = uracil
  modified_base 96: mod_base = OTHER; note = uracil
  modified_base 107: mod_base = OTHER; note = uracil
  modified_base 108: mod_base = OTHER; note = uracil
  modified_base 115: mod_base = OTHER; note = uracil
  modified_base 135: mod_base = OTHER; note = uracil
  modified_base 139: mod_base = OTHER; note = uracil
  modified_base 142: mod_base = OTHER; note = uracil
  modified_base 148: mod_base = OTHER; note = uracil
  modified_base 154: mod_base = OTHER; note = uracil
  modified_base 162: mod_base = OTHER; note = uracil
  modified_base 173: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 183: mod_base = OTHER; note = uracil
  modified_base 192: mod_base = OTHER; note = uracil
  modified_base 196: mod_base = OTHER; note = uracil
  modified_base 201: mod_base = OTHER; note = uracil
  modified_base 207: mod_base = OTHER; note = uracil
  modified_base 208: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 232: mod_base = OTHER; note = uracil
  modified_base 233: mod_base = OTHER; note = uracil
  modified_base 248: mod_base = OTHER; note = uracil
  modified_base 268: mod_base = OTHER; note = uracil
  modified_base 269: mod_base = OTHER; note = uracil
  modified_base 275: mod_base = OTHER; note = uracil
  modified_base 278: mod_base = OTHER; note = uracil
  modified_base 299: mod_base = OTHER; note = uracil
  modified_base 300: mod_base = OTHER; note = uracil
aataaaatgggggaaaatattttattttyggtagtggttatagagtatyggatttttagatattgaatgagttatttgtaggagaaatgagatttttgtggaagggtttggatgtagaygtgggggtggaggaatagattgttgtttttygagtyggtggttttgatgtaattttttttgattagttaatatatttagtgtaattattatgaaaattttttaaatattgagttattgataaaaattgttaggaaattaaggtaaattttagatgtattaaaggtttgtgtgtttagaatt

SEQ ID NO: 409 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 21: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 66: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 87: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 102: mod_base = OTHER; note = uracil
  modified_base 112: mod_base = OTHER; note = uracil
  modified_base 113: mod_base = OTHER; note = uracil
  modified_base 120: mod_base = OTHER; note = uracil
  modified_base 125: mod_base = OTHER; note = uracil
  modified_base 129: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 156: mod_base = OTHER; note = uracil
  modified_base 162: mod_base = OTHER; note = uracil
  modified_base 172: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 209: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 271: mod_base = OTHER; note = uracil
  modified_base 276: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 298: mod_base = OTHER; note = uracil
tttggggggtagggagggtttagtttttttaggtttggttgtgttttttgttttttatttataattaggtttagggttggggggtgtatattaaggaggggtaggaagtgtttaagaagtagaatyggttttgtgtttttagtggyggygggtgtttggggtaggaggaggttatttgattttttttttattgtttyggttatgattttttttttttttttttygttttttttttttttttttttttttttttttttttttttttttttttatggttggggtagttagtattttgggttg

SEQ ID NO: 410 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 12: mod_base = OTHER; note = uracil
  modified_base 16: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 96: mod_base = OTHER; note = uracil
  modified_base 101: mod_base = OTHER; note = uracil
  modified_base 107: mod_base = OTHER; note = uracil
  modified_base 122: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 152: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 165: mod_base = OTHER; note = uracil
  modified_base 167: mod_base = OTHER; note = uracil
  modified_base 172: mod_base = OTHER; note = uracil
  modified_base 178: mod_base = OTHER; note = uracil
  modified_base 181: mod_base = OTHER; note = uracil
  modified_base 184: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 232: mod_base = OTHER; note = uracil
  modified_base 250: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 267: mod_base = OTHER; note = uracil
  modified_base 268: mod_base = OTHER; note = uracil
  modified_base 277: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 296: mod_base = OTHER; note = uracil
agtttagggtgttggttattttagttatgaaggaggagggagggagggagggagggagggagggagggagggagygagggagggagggaggaggttatggtyggggtagtggggaagggattagatagtttttttttgttttagatattygtygttattggggatatagagtyggttttgttttttggatattttttgtttttttttggtgtgtattttttaattttgggtttgattgtgggtggggggtaggggatatagttaggtttgaggggattgaattttttttgttttttaaag

SEQ ID NO: 411 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 5: mod_base = OTHER; note = uracil
  modified_base 9: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 24: mod_base = OTHER; note = uracil
  modified_base 25: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 52: mod_base = OTHER; note = uracil
  modified_base 53: mod_base = OTHER; note = uracil
  modified_base 57: mod_base = OTHER; note = uracil
  modified_base 65: mod_base = OTHER; note = uracil
  modified_base 66: mod_base = OTHER; note = uracil
  modified_base 72: mod_base = OTHER; note = uracil
  modified_base 96: mod_base = OTHER; note = uracil
  modified_base 97: mod_base = OTHER; note = uracil
  modified_base 101: mod_base = OTHER; note = uracil
  modified_base 106: mod_base = OTHER; note = uracil
  modified_base 113: mod_base = OTHER; note = uracil
  modified_base 115: mod_base = OTHER; note = uracil
  modified_base 127: mod_base = OTHER; note = uracil
  modified_base 128: mod_base = OTHER; note = uracil
  modified_base 135: mod_base = OTHER; note = uracil
  modified_base 137: mod_base = OTHER; note = uracil
  modified_base 145: mod_base = OTHER; note = uracil
  modified_base 153: mod_base = OTHER; note = uracil
  modified_base 157: mod_base = OTHER; note = uracil
  modified_base 168: mod_base = OTHER; note = uracil
  modified_base 169: mod_base = OTHER; note = uracil
  modified_base 174: mod_base = OTHER; note = uracil
  modified_base 176: mod_base = OTHER; note = uracil
  modified_base 180: mod_base = OTHER; note = uracil
  modified_base 182: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 207: mod_base = OTHER; note = uracil
  modified_base 214: mod_base = OTHER; note = uracil
  modified_base 219: mod_base = OTHER; note = uracil
  modified_base 220: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 275: mod_base = OTHER; note = uracil
  modified_base 280: mod_base = OTHER; note = uracil
  modified_base 281: mod_base = OTHER; note = uracil
  modified_base 288: mod_base = OTHER; note = uracil
  modified_base 289: mod_base = OTHER; note = uracil
  modified_base 291: mod_base = OTHER; note = uracil
ttygtaagtttygtttttttaggtttygttttttttttttgtagagagtggttaagttygtgttttagaggttgaatgaggattttgtgyggaagttygattatgttttgagttttgtgggtaagattyggagatattggaagatagagaygtagataggaaagaggttaagatattgatatagatagatttatgtatttgatyggtygaagatagagtttyggatagtttttattygtttttagttttygygttttygygtttygattttyggtaaggtttgggagtttttgagggtta

SEQ ID NO: 412 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 22: mod_base = OTHER; note = uracil
  modified_base 23: mod_base = OTHER; note = uracil
  modified_base 27: mod_base = OTHER; note = uracil
  modified_base 56: mod_base = OTHER; note = uracil
  modified_base 73: mod_base = OTHER; note = uracil
  modified_base 77: mod_base = OTHER; note = uracil
  modified_base 83: mod_base = OTHER; note = uracil
  modified_base 85: mod_base = OTHER; note = uracil
  modified_base 89: mod_base = OTHER; note = uracil
  modified_base 95: mod_base = OTHER; note = uracil
  modified_base 100: mod_base = OTHER; note = uracil
  modified_base 106: mod_base = OTHER; note = uracil
  modified_base 113: mod_base = OTHER; note = uracil
  modified_base 117: mod_base = OTHER; note = uracil
  modified_base 123: mod_base = OTHER; note = uracil
  modified_base 129: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 152: mod_base = OTHER; note = uracil
  modified_base 154: mod_base = OTHER; note = uracil
  modified_base 158: mod_base = OTHER; note = uracil
  modified_base 161: mod_base = OTHER; note = uracil
  modified_base 162: mod_base = OTHER; note = uracil
  modified_base 168: mod_base = OTHER; note = uracil
  modified_base 170: mod_base = OTHER; note = uracil
  modified_base 176: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 189: mod_base = OTHER; note = uracil
  modified_base 191: mod_base = OTHER; note = uracil
  modified_base 196: mod_base = OTHER; note = uracil
  modified_base 206: mod_base = OTHER; note = uracil
  modified_base 209: mod_base = OTHER; note = uracil
  modified_base 212: mod_base = OTHER; note = uracil
  modified_base 214: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 227: mod_base = OTHER; note = uracil
  modified_base 230: mod_base = OTHER; note = uracil
  modified_base 231: mod_base = OTHER; note = uracil
  modified_base 233: mod_base = OTHER; note = uracil
  modified_base 239: mod_base = OTHER; note = uracil
  modified_base 245: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 260: mod_base = OTHER; note = uracil
  modified_base 278: mod_base = OTHER; note = uracil
  modified_base 279: mod_base = OTHER; note = uracil
  modified_base 293: mod_base = OTHER; note = uracil
taatttttagaggtttttaggttttgtygggagtyggggygygggggygygggggttgggggygggtgggggttgttygaggttttgttttyggtyggttaggtgtatgggtttgtttgtgttagtgttttggttttttttttgtttgygtttttgttttttagtgttttygggttttatttatagagtttaaagtatagtygggttttygtataaaatttttatttagtttttggaataygagtttggttattttttgtaaggagggagggygaggtttggaggggygaggtttgyggg

SEQ ID NO: 413 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 19: mod_base = OTHER; note = uracil
  modified_base 24: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 64: mod_base = OTHER; note = uracil
  modified_base 76: mod_base = OTHER; note = uracil
  modified_base 85: mod_base = OTHER; note = uracil
  modified_base 91: mod_base = OTHER; note = uracil
  modified_base 100: mod_base = OTHER; note = uracil
  modified_base 103: mod_base = OTHER; note = uracil
  modified_base 106: mod_base = OTHER; note = uracil
  modified_base 111: mod_base = OTHER; note = uracil
  modified_base 117: mod_base = OTHER; note = uracil
  modified_base 121: mod_base = OTHER; note = uracil
  modified_base 124: mod_base = OTHER; note = uracil
  modified_base 127: mod_base = OTHER; note = uracil
  modified_base 131: mod_base = OTHER; note = uracil
  modified_base 136: mod_base = OTHER; note = uracil
  modified_base 138: mod_base = OTHER; note = uracil
  modified_base 141: mod_base = OTHER; note = uracil
  modified_base 143: mod_base = OTHER; note = uracil
  modified_base 158: mod_base = OTHER; note = uracil
  modified_base 160: mod_base = OTHER; note = uracil
  modified_base 178: mod_base = OTHER; note = uracil
  modified_base 179: mod_base = OTHER; note = uracil
  modified_base 190: mod_base = OTHER; note = uracil
  modified_base 192: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 221: mod_base = OTHER; note = uracil
  modified_base 239: mod_base = OTHER; note = uracil
  modified_base 245: mod_base = OTHER; note = uracil
  modified_base 247: mod_base = OTHER; note = uracil
  modified_base 249: mod_base = OTHER; note = uracil
  modified_base 251: mod_base = OTHER; note = uracil
  modified_base 266: mod_base = OTHER; note = uracil
  modified_base 291: mod_base = OTHER; note = uracil
  modified_base 297: mod_base = OTHER; note = uracil
  modified_base 298: mod_base = OTHER; note = uracil
  modified_base 299: mod_base = OTHER; note = uracil
tagattagggtttttagatttgttyggagggagggttttgtatatttgttaaygttttgtttgttgggaaaggggttgatgttgtaatgataggttaaatagtaataggatattgattggtatttgtaagttgagtttagtttagagaggygaggagtataggggagggaggaaaatttyggtgtggattttatttatayggtttattgggtgtttttggtagayggaattatgggtgtttttatttttttattttaaaaatgtgttttttatgtgtattgtaaaagtaatagattttta

SEQ ID NO: 414 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 14: mod_base = OTHER; note = uracil
  modified_base 20: mod_base = OTHER; note = uracil
  modified_base 25: mod_base = OTHER; note = uracil
  modified_base 27: mod_base = OTHER; note = uracil
  modified_base 36: mod_base = OTHER; note = uracil
  modified_base 38: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 74: mod_base = OTHER; note = uracil
  modified_base 78: mod_base = OTHER; note = uracil
  modified_base 81: mod_base = OTHER; note = uracil
  modified_base 82: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 99: mod_base = OTHER; note = uracil
  modified_base 114: mod_base = OTHER; note = uracil
  modified_base 115: mod_base = OTHER; note = uracil
  modified_base 117: mod_base = OTHER; note = uracil
  modified_base 119: mod_base = OTHER; note = uracil
  modified_base 129: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 154: mod_base = OTHER; note = uracil
  modified_base 156: mod_base = OTHER; note = uracil
  modified_base 161: mod_base = OTHER; note = uracil
  modified_base 166: mod_base = OTHER; note = uracil
  modified_base 168: mod_base = OTHER; note = uracil
  modified_base 171: mod_base = OTHER; note = uracil
  modified_base 175: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 192: mod_base = OTHER; note = uracil
  modified_base 193: mod_base = OTHER; note = uracil
  modified_base 199: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 217: mod_base = OTHER; note = uracil
  modified_base 220: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 242: mod_base = OTHER; note = uracil
  modified_base 253: mod_base = OTHER; note = uracil
  modified_base 261: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 279: mod_base = OTHER; note = uracil
  modified_base 284: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 298: mod_base = OTHER; note = uracil
tgggaatttgttatttttataatatatataaaaagtatatttttaaaatgagagagtaaaagtatttataatttygtttgttaggagtatttagtgggtygtgtgggtgagatttatatygggattttttttttttttttgtgtttttygtttttttgagttgagtttagtttgtagatgttagttaatgttttgttgttgtttaatttgttattgtaatattagttttttttttagtaaatagggygttggtaggtatgtagggtttttttttyggataagtttgaggattttgatttg

SEQ ID NO: 415 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 8: mod_base = OTHER; note = uracil
  modified_base 10: mod_base = OTHER; note = uracil
  modified_base 17: mod_base = OTHER; note = uracil
  modified_base 23: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 52: mod_base = OTHER; note = uracil
  modified_base 53: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 80: mod_base = OTHER; note = uracil
  modified_base 83: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 133: mod_base = OTHER; note = uracil
  modified_base 141: mod_base = OTHER; note = uracil
  modified_base 146: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 162: mod_base = OTHER; note = uracil
  modified_base 165: mod_base = OTHER; note = uracil
  modified_base 167: mod_base = OTHER; note = uracil
  modified_base 171: mod_base = OTHER; note = uracil
  modified_base 176: mod_base = OTHER; note = uracil
  modified_base 186: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 203: mod_base = OTHER; note = uracil
  modified_base 207: mod_base = OTHER; note = uracil
  modified_base 212: mod_base = OTHER; note = uracil
  modified_base 216: mod_base = OTHER; note = uracil
  modified_base 218: mod_base = OTHER; note = uracil
  modified_base 223: mod_base = OTHER; note = uracil
  modified_base 224: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 238: mod_base = OTHER; note = uracil
  modified_base 242: mod_base = OTHER; note = uracil
  modified_base 247: mod_base = OTHER; note = uracil
  modified_base 261: mod_base = OTHER; note = uracil
  modified_base 262: mod_base = OTHER; note = uracil
  modified_base 270: mod_base = OTHER; note = uracil
  modified_base 277: mod_base = OTHER; note = uracil
  modified_base 282: mod_base = OTHER; note = uracil
  modified_base 286: mod_base = OTHER; note = uracil
  modified_base 288: mod_base = OTHER; note = uracil
  modified_base 292: mod_base = OTHER; note = uracil
  modified_base 293: mod_base = OTHER; note = uracil
  modified_base 300: mod_base = OTHER; note = uracil
tatttggttttygtggttgggatagattgtttttttttttttttttgggtgttaggtaggtttagaaattatttgatgttagtaaggtttggttatttattggtggggaggaagtgggygggtgtttagggatagatgagtygggtagaygtgttttgaggtagtatagttagggttgaygtgggtattatgtatttyggggtttttagagttggtttyggtttygtttgtttatattaagtaggttagagtggagagggttaggggygttggggttaaggtatgtattgattaggygtt

SEQ ID NO: 416 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 11: mod_base = OTHER; note = uracil
  modified_base 16: mod_base = OTHER; note = uracil
  modified_base 20: mod_base = OTHER; note = uracil
  modified_base 21: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 71: mod_base = OTHER; note = uracil
  modified_base 80: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 92: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 109: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 148: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 166: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 177: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 209: mod_base = OTHER; note = uracil
  modified_base 210: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 223: mod_base = OTHER; note = uracil
  modified_base 226: mod_base = OTHER; note = uracil
  modified_base 236: mod_base = OTHER; note = uracil
  modified_base 241: mod_base = OTHER; note = uracil
  modified_base 242: mod_base = OTHER; note = uracil
  modified_base 245: mod_base = OTHER; note = uracil
  modified_base 246: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 272: mod_base = OTHER; note = uracil
  modified_base 276: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 294: mod_base = OTHER; note = uracil
  modified_base 295: mod_base = OTHER; note = uracil
gaygtttggttagtgtatgttttgattttagygtttttggttttttttattttgatttgtttgatgtgggtaaaygggatyggagttagttttgaaagtttygaggtgtataatgtttaygttagttttgattgtgttgttttagggtaygtttgttyggtttatttgtttttgggtattygtttattttttttttattagtgggtggttaggttttgttgatattaggtggtttttgggtttatttggtatttaggagagaggaaggaagtaatttgttttagttaygagagttaagtg

SEQ ID NO: 417 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 8: mod_base = OTHER; note = uracil
  modified_base 14: mod_base = OTHER; note = uracil
  modified_base 18: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 31: mod_base = OTHER; note = uracil
  modified_base 32: mod_base = OTHER; note = uracil
  modified_base 46: mod_base = OTHER; note = uracil
  modified_base 53: mod_base = OTHER; note = uracil
  modified_base 54: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 113: mod_base = OTHER; note = uracil
  modified_base 114: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 127: mod_base = OTHER; note = uracil
  modified_base 128: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 157: mod_base = OTHER; note = uracil
  modified_base 159: mod_base = OTHER; note = uracil
  modified_base 163: mod_base = OTHER; note = uracil
  modified_base 169: mod_base = OTHER; note = uracil
  modified_base 170: mod_base = OTHER; note = uracil
  modified_base 182: mod_base = OTHER; note = uracil
  modified_base 186: mod_base = OTHER; note = uracil
  modified_base 192: mod_base = OTHER; note = uracil
  modified_base 195: mod_base = OTHER; note = uracil
  modified_base 197: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 214: mod_base = OTHER; note = uracil
  modified_base 219: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 248: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 264: mod_base = OTHER; note = uracil
  modified_base 266: mod_base = OTHER; note = uracil
  modified_base 268: mod_base = OTHER; note = uracil
  modified_base 272: mod_base = OTHER; note = uracil
  modified_base 276: mod_base = OTHER; note = uracil
  modified_base 278: mod_base = OTHER; note = uracil
  modified_base 291: mod_base = OTHER; note = uracil
atttatatttgaatatatagatatttttttttagggtgtgttgtgttygatatttttaatttttgtttgtattttagggtttgtttagtttttttttggttttttagtttagtttggttttttyggtttttttgttatttttatttttygtgtgtgtataagtagggattaggtagggagatyggtagatgttgttttttgtttttggggtttttttttttagtgttgtttttatatttaygygatgttttaattaattgttatatttaggtttttttagtggggagagttagaaataga

SEQ ID NO: 418 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 11: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 29: mod_base = OTHER; note = uracil
  modified_base 30: mod_base = OTHER; note = uracil
  modified_base 40: mod_base = OTHER; note = uracil
  modified_base 53: mod_base = OTHER; note = uracil
  modified_base 72: mod_base = OTHER; note = uracil
  modified_base 75: mod_base = OTHER; note = uracil
  modified_base 77: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 99: mod_base = OTHER; note = uracil
  modified_base 106: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 166: mod_base = OTHER; note = uracil
  modified_base 174: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 193: mod_base = OTHER; note = uracil
  modified_base 201: mod_base = OTHER; note = uracil
  modified_base 202: mod_base = OTHER; note = uracil
  modified_base 212: mod_base = OTHER; note = uracil
  modified_base 217: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 231: mod_base = OTHER; note = uracil
  modified_base 235: mod_base = OTHER; note = uracil
  modified_base 255: mod_base = OTHER; note = uracil
  modified_base 257: mod_base = OTHER; note = uracil
  modified_base 260: mod_base = OTHER; note = uracil
  modified_base 262: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 280: mod_base = OTHER; note = uracil
  modified_base 289: mod_base = OTHER; note = uracil
ttatttttgattttttttattgagaaagtttgagtgtggtagttaattaaagtatygygtgggtgtgggagtaatattaagaaaagaaattttagggatagagagtagtatttgtyggtttttttatttggtttttgtttgtgtatataygagaggtggggatgatagggaggtyggaaggattaggttgggttggggagttaggaagaggttgggtaggttttggaatgtagataggaattaaaggtatygagtataatatattttggaaaaggatgtttgtatgtttaagtgtggatg

SEQ ID NO: 419 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 15: mod_base = OTHER; note = uracil
  modified_base 19: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 49: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 90: mod_base = OTHER; note = uracil
  modified_base 93: mod_base = OTHER; note = uracil
  modified_base 97: mod_base = OTHER; note = uracil
  modified_base 100: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 115: mod_base = OTHER; note = uracil
  modified_base 129: mod_base = OTHER; note = uracil
  modified_base 132: mod_base = OTHER; note = uracil
  modified_base 136: mod_base = OTHER; note = uracil
  modified_base 139: mod_base = OTHER; note = uracil
  modified_base 146: mod_base = OTHER; note = uracil
  modified_base 152: mod_base = OTHER; note = uracil
  modified_base 154: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 184: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 219: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 245: mod_base = OTHER; note = uracil
  modified_base 249: mod_base = OTHER; note = uracil
  modified_base 257: mod_base = OTHER; note = uracil
  modified_base 260: mod_base = OTHER; note = uracil
  modified_base 266: mod_base = OTHER; note = uracil
  modified_base 273: mod_base = OTHER; note = uracil
  modified_base 284: mod_base = OTHER; note = uracil
  modified_base 289: mod_base = OTHER; note = uracil
  modified_base 294: mod_base = OTHER; note = uracil
  modified_base 296: mod_base = OTHER; note = uracil
  modified_base 299: mod_base = OTHER; note = uracil
ttttagttatttygtagttatttttgatttagaaaagaataattatagttgggtttagtatttygggttattttttgtagttgtttatatatttggtagttgggtttatttatgtaatgtggatygggttttttatatttgaaatttgygtttttattttttttttgagattagtgttttttgttagtttttatggtttygggatgattttatttttttagggtttttttgygttttgggagttttggtygaggagtagtaggggttgatggtagagygggggtaggttagagtttagta

SEQ ID NO: 420 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 9: mod_base = OTHER; note = uracil
  modified_base 13: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 23: mod_base = OTHER; note = uracil
  modified_base 25: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 41: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 52: mod_base = OTHER; note = uracil
  modified_base 53: mod_base = OTHER; note = uracil
  modified_base 58: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 69: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 94: mod_base = OTHER; note = uracil
  modified_base 97: mod_base = OTHER; note = uracil
  modified_base 98: mod_base = OTHER; note = uracil
  modified_base 104: mod_base = OTHER; note = uracil
  modified_base 105: mod_base = OTHER; note = uracil
  modified_base 113: mod_base = OTHER; note = uracil
  modified_base 117: mod_base = OTHER; note = uracil
  modified_base 124: mod_base = OTHER; note = uracil
  modified_base 126: mod_base = OTHER; note = uracil
  modified_base 131: mod_base = OTHER; note = uracil
  modified_base 133: mod_base = OTHER; note = uracil
  modified_base 152: mod_base = OTHER; note = uracil
  modified_base 159: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 186: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 217: mod_base = OTHER; note = uracil
  modified_base 220: mod_base = OTHER; note = uracil
  modified_base 223: mod_base = OTHER; note = uracil
  modified_base 233: mod_base = OTHER; note = uracil
  modified_base 234: mod_base = OTHER; note = uracil
  modified_base 242: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 263: mod_base = OTHER; note = uracil
  modified_base 268: mod_base = OTHER; note = uracil
  modified_base 274: mod_base = OTHER; note = uracil
  modified_base 283: mod_base = OTHER; note = uracil
  modified_base 294: mod_base = OTHER; note = uracil
  modified_base 300: mod_base = OTHER; note = uracil
gttgagttttgatttgttttygttttgttattagtttttgttgtttttyggttagagtttttaggaygtagggagattttgggagagtgaggttatttyggggttatggaagttggtaggagatattggttttagaggagggatagagaygtagattttagatgtaagaagttygatttatattgtataagtggatttagttgttagatgtgtgggtagttgtagggagtggttyggggtgttgggtttagttgtggttgtttttttttgggttaggagtgattgyggagtggttgggat

SEQ ID NO: 421 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 11: mod_base = OTHER; note = uracil
  modified_base 13: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 37: mod_base = OTHER; note = uracil
  modified_base 41: mod_base = OTHER; note = uracil
  modified_base 43: mod_base = OTHER; note = uracil
  modified_base 45: mod_base = OTHER; note = uracil
  modified_base 49: mod_base = OTHER; note = uracil
  modified_base 51: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 60: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 73: mod_base = OTHER; note = uracil
  modified_base 81: mod_base = OTHER; note = uracil
  modified_base 82: mod_base = OTHER; note = uracil
  modified_base 89: mod_base = OTHER; note = uracil
  modified_base 91: mod_base = OTHER; note = uracil
  modified_base 93: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 135: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 160: mod_base = OTHER; note = uracil
  modified_base 161: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 189: mod_base = OTHER; note = uracil
  modified_base 190: mod_base = OTHER; note = uracil
  modified_base 195: mod_base = OTHER; note = uracil
  modified_base 197: mod_base = OTHER; note = uracil
  modified_base 202: mod_base = OTHER; note = uracil
  modified_base 215: mod_base = OTHER; note = uracil
  modified_base 220: mod_base = OTHER; note = uracil
  modified_base 221: mod_base = OTHER; note = uracil
  modified_base 232: mod_base = OTHER; note = uracil
  modified_base 235: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 250: mod_base = OTHER; note = uracil
  modified_base 255: mod_base = OTHER; note = uracil
  modified_base 256: mod_base = OTHER; note = uracil
  modified_base 262: mod_base = OTHER; note = uracil
  modified_base 267: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 282: mod_base = OTHER; note = uracil
  modified_base 284: mod_base = OTHER; note = uracil
  modified_base 292: mod_base = OTHER; note = uracil
  modified_base 295: mod_base = OTHER; note = uracil
  modified_base 300: mod_base = OTHER; note = uracil
ttaaaygyggtatayggggayggtttttttyggggttaggtttattggttttttttttttagygttattaggtaggagggttaayggttatataggaggtatttttatttgtttttgtattagtaaataaagtgtattttattttygtgtgagygtyggttyggtgagttagttttttygggtttttttttgtttttagggtagggggygtgygttgagttagaggtagatttgtagaaagggtttygattgggtttygggtagggtyggygtttattatattttgggggttagttatgt

SEQ ID NO: 422 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 64: mod_base = OTHER; note = uracil
  modified_base 67: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 82: mod_base = OTHER; note = uracil
  modified_base 84: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 109: mod_base = OTHER; note = uracil
  modified_base 119: mod_base = OTHER; note = uracil
  modified_base 120: mod_base = OTHER; note = uracil
  modified_base 129: mod_base = OTHER; note = uracil
  modified_base 133: mod_base = OTHER; note = uracil
  modified_base 135: mod_base = OTHER; note = uracil
  modified_base 137: mod_base = OTHER; note = uracil
  modified_base 142: mod_base = OTHER; note = uracil
  modified_base 148: mod_base = OTHER; note = uracil
  modified_base 150: mod_base = OTHER; note = uracil
  modified_base 152: mod_base = OTHER; note = uracil
  modified_base 167: mod_base = OTHER; note = uracil
  modified_base 169: mod_base = OTHER; note = uracil
  modified_base 178: mod_base = OTHER; note = uracil
  modified_base 184: mod_base = OTHER; note = uracil
  modified_base 190: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 214: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 239: mod_base = OTHER; note = uracil
  modified_base 253: mod_base = OTHER; note = uracil
  modified_base 254: mod_base = OTHER; note = uracil
  modified_base 261: mod_base = OTHER; note = uracil
  modified_base 262: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 278: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 291: mod_base = OTHER; note = uracil
gtatagttgatttttagagtgtggtgggygtyggttttgttygaggtttagtyggggttttttttgtagatttatttttggtttagygtaygttttttgttttgagaataggaaagggttyggaagggttgatttatygggtygaygtttataygaaaatgggatgtattttatttgttggtgtaaaggtaggtgagggtgttttttgtgtgatygttggtttttttgtttggtggygttgaagggaaggagttagtgagtttgatttygggaggggtygttttygtgtgtygygtttgg

SEQ ID NO: 423 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 32: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 55: mod_base = OTHER; note = uracil
  modified_base 56: mod_base = OTHER; note = uracil
  modified_base 62: mod_base = OTHER; note = uracil
  modified_base 65: mod_base = OTHER; note = uracil
  modified_base 67: mod_base = OTHER; note = uracil
  modified_base 76: mod_base = OTHER; note = uracil
  modified_base 85: mod_base = OTHER; note = uracil
  modified_base 86: mod_base = OTHER; note = uracil
  modified_base 112: mod_base = OTHER; note = uracil
  modified_base 116: mod_base = OTHER; note = uracil
  modified_base 118: mod_base = OTHER; note = uracil
  modified_base 124: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 137: mod_base = OTHER; note = uracil
  modified_base 139: mod_base = OTHER; note = uracil
  modified_base 145: mod_base = OTHER; note = uracil
  modified_base 147: mod_base = OTHER; note = uracil
  modified_base 155: mod_base = OTHER; note = uracil
  modified_base 156: mod_base = OTHER; note = uracil
  modified_base 164: mod_base = OTHER; note = uracil
  modified_base 172: mod_base = OTHER; note = uracil
  modified_base 173: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 187: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 210: mod_base = OTHER; note = uracil
  modified_base 213: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 261: mod_base = OTHER; note = uracil
  modified_base 263: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 297: mod_base = OTHER; note = uracil
  modified_base 298: mod_base = OTHER; note = uracil
  modified_base 299: mod_base = OTHER; note = uracil
gtaggaagggtttagaygatatttttatagatatatgttagttttttygggtgattaaaattattttagtaaaggtagatgaggttaagygaaaaggggtgggtggaagaatyggttttgagttttagtttatagatattyggatattygtyggttyggtaggtaggggtttttggtggttttaggttgttaggttyggttttttttygtagttgtttttagtttttatttttttygtttattttttaggatttttattttattgaggagattaagattatttggygagaatttttttta

SEQ ID NO: 424 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 15: mod_base = OTHER; note = uracil
  modified_base 16: mod_base = OTHER; note = uracil
  modified_base 24: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 50: mod_base = OTHER; note = uracil
  modified_base 51: mod_base = OTHER; note = uracil
  modified_base 78: mod_base = OTHER; note = uracil
  modified_base 85: mod_base = OTHER; note = uracil
  modified_base 88: mod_base = OTHER; note = uracil
  modified_base 101: mod_base = OTHER; note = uracil
  modified_base 106: mod_base = OTHER; note = uracil
  modified_base 107: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 146: mod_base = OTHER; note = uracil
  modified_base 157: mod_base = OTHER; note = uracil
  modified_base 165: mod_base = OTHER; note = uracil
  modified_base 172: mod_base = OTHER; note = uracil
  modified_base 178: mod_base = OTHER; note = uracil
  modified_base 180: mod_base = OTHER; note = uracil
  modified_base 185: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 247: mod_base = OTHER; note = uracil
  modified_base 249: mod_base = OTHER; note = uracil
  modified_base 250: mod_base = OTHER; note = uracil
  modified_base 259: mod_base = OTHER; note = uracil
  modified_base 263: mod_base = OTHER; note = uracil
  modified_base 270: mod_base = OTHER; note = uracil
  modified_base 285: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 295: mod_base = OTHER; note = uracil
  modified_base 296: mod_base = OTHER; note = uracil
  modified_base 299: mod_base = OTHER; note = uracil
gggaggggttttygttaggtggttttaatttttttagtgaaataggagttttggggggtgggygggggaggtgggagttggagatagttgygggagggggtygggtttgatagtttgaggttattaggaatttttgtttatygggtygaygagtgttygagtgtttgtgggttgagatttagagtyggtttttttatttattttttttygtttggttttatttgtttttattgagatgattttggttattyggaggggttggtatatgtttgtgggggtgtygtttgggttttttttgtt

SEQ ID NO: 425 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 25: mod_base = OTHER; note = uracil
  modified_base 32: mod_base = OTHER; note = uracil
  modified_base 46: mod_base = OTHER; note = uracil
  modified_base 49: mod_base = OTHER; note = uracil
  modified_base 74: mod_base = OTHER; note = uracil
  modified_base 92: mod_base = OTHER; note = uracil
  modified_base 94: mod_base = OTHER; note = uracil
  modified_base 97: mod_base = OTHER; note = uracil
  modified_base 102: mod_base = OTHER; note = uracil
  modified_base 110: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 142: mod_base = OTHER; note = uracil
  modified_base 144: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 173: mod_base = OTHER; note = uracil
  modified_base 182: mod_base = OTHER; note = uracil
  modified_base 204: mod_base = OTHER; note = uracil
  modified_base 210: mod_base = OTHER; note = uracil
  modified_base 211: mod_base = OTHER; note = uracil
  modified_base 214: mod_base = OTHER; note = uracil
  modified_base 218: mod_base = OTHER; note = uracil
  modified_base 221: mod_base = OTHER; note = uracil
  modified_base 233: mod_base = OTHER; note = uracil
  modified_base 237: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 249: mod_base = OTHER; note = uracil
  modified_base 252: mod_base = OTHER; note = uracil
  modified_base 255: mod_base = OTHER; note = uracil
  modified_base 257: mod_base = OTHER; note = uracil
  modified_base 261: mod_base = OTHER; note = uracil
  modified_base 264: mod_base = OTHER; note = uracil
  modified_base 276: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 294: mod_base = OTHER; note = uracil
  modified_base 295: mod_base = OTHER; note = uracil
aggtgagatttggaggttgyggggtagttagtaagtgggagagagttgtatgyggggaaggtgggaggygttgtaggaaaggtgagggagatatagttgagttgtggtgttggttagttggggttttgygttttattygggtattgtgayggttattaataggttttaagtatyggaatgatatgatyggatttgtaatttaattagatttttttgattgttgttgggggaatagattgttaattttataatagtattgttagttgagtattagataaatgatgaatttgggtttaggga

SEQ ID NO: 426 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 16: mod_base = OTHER; note = uracil
  modified_base 19: mod_base = OTHER; note = uracil
  modified_base 26: mod_base = OTHER; note = uracil
  modified_base 32: mod_base = OTHER; note = uracil
  modified_base 34: mod_base = OTHER; note = uracil
  modified_base 37: mod_base = OTHER; note = uracil
  modified_base 41: mod_base = OTHER; note = uracil
  modified_base 46: mod_base = OTHER; note = uracil
  modified_base 61: mod_base = OTHER; note = uracil
  modified_base 65: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 80: mod_base = OTHER; note = uracil
  modified_base 84: mod_base = OTHER; note = uracil
  modified_base 93: mod_base = OTHER; note = uracil
  modified_base 105: mod_base = OTHER; note = uracil
  modified_base 110: mod_base = OTHER; note = uracil
  modified_base 115: mod_base = OTHER; note = uracil
  modified_base 120: mod_base = OTHER; note = uracil
  modified_base 124: mod_base = OTHER; note = uracil
  modified_base 130: mod_base = OTHER; note = uracil
  modified_base 137: mod_base = OTHER; note = uracil
  modified_base 138: mod_base = OTHER; note = uracil
  modified_base 148: mod_base = OTHER; note = uracil
  modified_base 152: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 172: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 252: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 265: mod_base = OTHER; note = uracil
  modified_base 269: mod_base = OTHER; note = uracil
  modified_base 273: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 284: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 295: mod_base = OTHER; note = uracil
  modified_base 297: mod_base = OTHER; note = uracil
  modified_base 298: mod_base = OTHER; note = uracil
ttttgggtttaggtttattatttgtttaatatttagttgatagtgttgttgtgaggttgatagtttgtttttttaatagtagttagaaggatttagttaaattataaattygattatgttatttyggtatttaaaatttgttagtggtygttatagtgttyggataaggygtaaggttttagttggttagtattatagtttagttgtgttttttttattttttttgtaaygttttttatttttttygtatgtagtttttttttatttgttaattgtttygtaatttttagattttatttg

SEQ ID NO: 427 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 18: mod_base = OTHER; note = uracil
  modified_base 26: mod_base = OTHER; note = uracil
  modified_base 29: mod_base = OTHER; note = uracil
  modified_base 30: mod_base = OTHER; note = uracil
  modified_base 40: mod_base = OTHER; note = uracil
  modified_base 45: mod_base = OTHER; note = uracil
  modified_base 52: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 80: mod_base = OTHER; note = uracil
  modified_base 83: mod_base = OTHER; note = uracil
  modified_base 90: mod_base = OTHER; note = uracil
  modified_base 91: mod_base = OTHER; note = uracil
  modified_base 100: mod_base = OTHER; note = uracil
  modified_base 106: mod_base = OTHER; note = uracil
  modified_base 113: mod_base = OTHER; note = uracil
  modified_base 138: mod_base = OTHER; note = uracil
  modified_base 139: mod_base = OTHER; note = uracil
  modified_base 157: mod_base = OTHER; note = uracil
  modified_base 158: mod_base = OTHER; note = uracil
  modified_base 164: mod_base = OTHER; note = uracil
  modified_base 166: mod_base = OTHER; note = uracil
  modified_base 169: mod_base = OTHER; note = uracil
  modified_base 170: mod_base = OTHER; note = uracil
  modified_base 172: mod_base = OTHER; note = uracil
  modified_base 180: mod_base = OTHER; note = uracil
  modified_base 181: mod_base = OTHER; note = uracil
  modified_base 188: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 215: mod_base = OTHER; note = uracil
  modified_base 227: mod_base = OTHER; note = uracil
  modified_base 229: mod_base = OTHER; note = uracil
  modified_base 238: mod_base = OTHER; note = uracil
  modified_base 245: mod_base = OTHER; note = uracil
  modified_base 248: mod_base = OTHER; note = uracil
  modified_base 258: mod_base = OTHER; note = uracil
  modified_base 260: mod_base = OTHER; note = uracil
  modified_base 271: mod_base = OTHER; note = uracil
  modified_base 283: mod_base = OTHER; note = uracil
  modified_base 297: mod_base = OTHER; note = uracil
  modified_base 300: mod_base = OTHER; note = uracil
tgtgttattttagaaagtaaggaygtttttaaagatgtttagagtagtgtttaaagggatgtttattggttagttttaatygttgtgaattyggaaaatttgagattggtgttagttaatttagaaagtttattttgttaaggttgaggaygtatgtttgtgatatagttttaggaagttttgatgatatgtgtttaaggtggttggggtgtagtttgattttatatatttagggagtatgagatattaattaagtatatttgagaaatatatyggtttggtttagaaaggygggataat

SEQ ID NO: 428 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 7: mod_base = OTHER; note = uracil
  modified_base 10: mod_base = OTHER; note = uracil
  modified_base 11: mod_base = OTHER; note = uracil
  modified_base 15: mod_base = OTHER; note = uracil
  modified_base 20: mod_base = OTHER; note = uracil
  modified_base 21: mod_base = OTHER; note = uracil
  modified_base 25: mod_base = OTHER; note = uracil
  modified_base 36: mod_base = OTHER; note = uracil
  modified_base 38: mod_base = OTHER; note = uracil
  modified_base 46: mod_base = OTHER; note = uracil
  modified_base 58: mod_base = OTHER; note = uracil
  modified_base 60: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 83: mod_base = OTHER; note = uracil
  modified_base 87: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 108: mod_base = OTHER; note = uracil
  modified_base 110: mod_base = OTHER; note = uracil
  modified_base 115: mod_base = OTHER; note = uracil
  modified_base 118: mod_base = OTHER; note = uracil
  modified_base 123: mod_base = OTHER; note = uracil
  modified_base 126: mod_base = OTHER; note = uracil
  modified_base 127: mod_base = OTHER; note = uracil
  modified_base 133: mod_base = OTHER; note = uracil
  modified_base 139: mod_base = OTHER; note = uracil
  modified_base 141: mod_base = OTHER; note = uracil
  modified_base 145: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 164: mod_base = OTHER; note = uracil
  modified_base 173: mod_base = OTHER; note = uracil
  modified_base 177: mod_base = OTHER; note = uracil
  modified_base 186: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 197: mod_base = OTHER; note = uracil
  modified_base 199: mod_base = OTHER; note = uracil
  modified_base 207: mod_base = OTHER; note = uracil
  modified_base 214: mod_base = OTHER; note = uracil
  modified_base 216: mod_base = OTHER; note = uracil
  modified_base 228: mod_base = OTHER; note = uracil
  modified_base 232: mod_base = OTHER; note = uracil
  modified_base 233: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 259: mod_base = OTHER; note = uracil
  modified_base 264: mod_base = OTHER; note = uracil
  modified_base 267: mod_base = OTHER; note = uracil
  modified_base 279: mod_base = OTHER; note = uracil
  modified_base 280: mod_base = OTHER; note = uracil
  modified_base 284: mod_base = OTHER; note = uracil
  modified_base 288: mod_base = OTHER; note = uracil
  modified_base 297: mod_base = OTHER; note = uracil
  modified_base 299: mod_base = OTHER; note = uracil
gttgtttygtttttttagattaaatygatgtattttttaagtgtatttaattgatgttttatgttttttaagtgtataaaattaagttatattttaattattttgggtatatgttattaggattttttgaggttgtgttataggtataygtttttaattttggtaaaataaattttttaaattaattgatattagttttagatttttygggtttatagyggttgggattgattagtgggtatttttttgaatattgttttgaatatttttggaagygtttttgttttttggggtaatata

SEQ ID NO: 429 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 28: mod_base = OTHER; note = uracil
  modified_base 30: mod_base = OTHER; note = uracil
  modified_base 31: mod_base = OTHER; note = uracil
  modified_base 34: mod_base = OTHER; note = uracil
  modified_base 43: mod_base = OTHER; note = uracil
  modified_base 45: mod_base = OTHER; note = uracil
  modified_base 48: mod_base = OTHER; note = uracil
  modified_base 52: mod_base = OTHER; note = uracil
  modified_base 53: mod_base = OTHER; note = uracil
  modified_base 61: mod_base = OTHER; note = uracil
  modified_base 71: mod_base = OTHER; note = uracil
  modified_base 75: mod_base = OTHER; note = uracil
  modified_base 77: mod_base = OTHER; note = uracil
  modified_base 79: mod_base = OTHER; note = uracil
  modified_base 81: mod_base = OTHER; note = uracil
  modified_base 86: mod_base = OTHER; note = uracil
  modified_base 96: mod_base = OTHER; note = uracil
  modified_base 102: mod_base = OTHER; note = uracil
  modified_base 105: mod_base = OTHER; note = uracil
  modified_base 130: mod_base = OTHER; note = uracil
  modified_base 132: mod_base = OTHER; note = uracil
  modified_base 137: mod_base = OTHER; note = uracil
  modified_base 143: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 188: mod_base = OTHER; note = uracil
  modified_base 194: mod_base = OTHER; note = uracil
  modified_base 209: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 238: mod_base = OTHER; note = uracil
  modified_base 253: mod_base = OTHER; note = uracil
  modified_base 261: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 297: mod_base = OTHER; note = uracil
  modified_base 298: mod_base = OTHER; note = uracil
tgagaataatgtttggtatgygaggagtattagtaaatygtgtttattattttagyggagtaaattgttgttgttttttatygggttttgggttattgaggttgttatttattaaagtgtgggttgtgatttattattaggttatgaaatyggtgtagtggtagtaattagtttttaaagaaatgaatyggggtygggygyggtggtttatatttgtaattttagtattttgggaggtygaggygggtggattaygaggttaagagatygagattattttggttaatatggtgaaattyg

SEQ ID NO: 430 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 10: mod_base = OTHER; note = uracil
  modified_base 11: mod_base = OTHER; note = uracil
  modified_base 19: mod_base = OTHER; note = uracil
  modified_base 20: mod_base = OTHER; note = uracil
  modified_base 29: mod_base = OTHER; note = uracil
  modified_base 35: mod_base = OTHER; note = uracil
  modified_base 37: mod_base = OTHER; note = uracil
  modified_base 42: mod_base = OTHER; note = uracil
  modified_base 43: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 76: mod_base = OTHER; note = uracil
  modified_base 85: mod_base = OTHER; note = uracil
  modified_base 95: mod_base = OTHER; note = uracil
  modified_base 96: mod_base = OTHER; note = uracil
  modified_base 98: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 116: mod_base = OTHER; note = uracil
  modified_base 121: mod_base = OTHER; note = uracil
  modified_base 130: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 143: mod_base = OTHER; note = uracil
  modified_base 146: mod_base = OTHER; note = uracil
  modified_base 148: mod_base = OTHER; note = uracil
  modified_base 155: mod_base = OTHER; note = uracil
  modified_base 160: mod_base = OTHER; note = uracil
  modified_base 161: mod_base = OTHER; note = uracil
  modified_base 173: mod_base = OTHER; note = uracil
  modified_base 175: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 184: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 228: mod_base = OTHER; note = uracil
  modified_base 231: mod_base = OTHER; note = uracil
  modified_base 234: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 259: mod_base = OTHER; note = uracil
  modified_base 268: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 281: mod_base = OTHER; note = uracil
  modified_base 285: mod_base = OTHER; note = uracil
  modified_base 286: mod_base = OTHER; note = uracil
  modified_base 290: mod_base = OTHER; note = uracil
  modified_base 297: mod_base = OTHER; note = uracil
  modified_base 299: mod_base = OTHER; note = uracil
ygggttttattatgttggttaggatggtttygattttttgatttygtgatttattygtttyggttttttaaagtgttgggattataggtgtgaattatygygttyggtttyggtttatttttttaagggttggttgttattattatatygattttatgatttagtaatgagttataatttatattttaataaatagtagttttagtaatttaaagttyggtgagagatagtaataatttgtttygttggaatgatgagtaygatttgttggtgtttttygtatattagatattattttta

SEQ ID NO: 431 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 20: mod_base = OTHER; note = uracil
  modified_base 25: mod_base = OTHER; note = uracil
  modified_base 28: mod_base = OTHER; note = uracil
  modified_base 45: mod_base = OTHER; note = uracil
  modified_base 50: mod_base = OTHER; note = uracil
  modified_base 53: mod_base = OTHER; note = uracil
  modified_base 60: mod_base = OTHER; note = uracil
  modified_base 66: mod_base = OTHER; note = uracil
  modified_base 79: mod_base = OTHER; note = uracil
  modified_base 81: mod_base = OTHER; note = uracil
  modified_base 93: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 108: mod_base = OTHER; note = uracil
  modified_base 110: mod_base = OTHER; note = uracil
  modified_base 111: mod_base = OTHER; note = uracil
  modified_base 115: mod_base = OTHER; note = uracil
  modified_base 121: mod_base = OTHER; note = uracil
  modified_base 126: mod_base = OTHER; note = uracil
  modified_base 133: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 150: mod_base = OTHER; note = uracil
  modified_base 153: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 172: mod_base = OTHER; note = uracil
  modified_base 175: mod_base = OTHER; note = uracil
  modified_base 183: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 231: mod_base = OTHER; note = uracil
  modified_base 235: mod_base = OTHER; note = uracil
  modified_base 236: mod_base = OTHER; note = uracil
  modified_base 247: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 264: mod_base = OTHER; note = uracil
  modified_base 265: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 280: mod_base = OTHER; note = uracil
  modified_base 281: mod_base = OTHER; note = uracil
  modified_base 285: mod_base = OTHER; note = uracil
  modified_base 292: mod_base = OTHER; note = uracil
  modified_base 297: mod_base = OTHER; note = uracil
aggatggaggtyggggaggtagygtygtyggygggggygggyggtygygtygtaggyggttggggtaagtgggtgyggtttaaygtggggggtayggtgtttttgattattyggtagaygttgtgtygygagtagaagtttttttttagtygtttgtgttagggggaagagttgtagtyggatygggtgaggttttyggggtgggyggygagygggyggtgggtttttygttygttygaygyggggttgtygggtttggttygttygttaggttggggattyggtygggtttattttyga

SEQ ID NO: 432 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 13: mod_base = OTHER; note = uracil
  modified_base 17: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 29: mod_base = OTHER; note = uracil
  modified_base 30: mod_base = OTHER; note = uracil
  modified_base 42: mod_base = OTHER; note = uracil
  modified_base 43: mod_base = OTHER; note = uracil
  modified_base 47: mod_base = OTHER; note = uracil
  modified_base 48: mod_base = OTHER; note = uracil
  modified_base 52: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 89: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 114: mod_base = OTHER; note = uracil
  modified_base 115: mod_base = OTHER; note = uracil
  modified_base 120: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 143: mod_base = OTHER; note = uracil
  modified_base 145: mod_base = OTHER; note = uracil
  modified_base 152: mod_base = OTHER; note = uracil
  modified_base 163: mod_base = OTHER; note = uracil
  modified_base 166: mod_base = OTHER; note = uracil
  modified_base 169: mod_base = OTHER; note = uracil
  modified_base 176: mod_base = OTHER; note = uracil
  modified_base 178: mod_base = OTHER; note = uracil
  modified_base 184: mod_base = OTHER; note = uracil
  modified_base 187: mod_base = OTHER; note = uracil
  modified_base 196: mod_base = OTHER; note = uracil
  modified_base 202: mod_base = OTHER; note = uracil
  modified_base 204: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 242: mod_base = OTHER; note = uracil
  modified_base 245: mod_base = OTHER; note = uracil
  modified_base 246: mod_base = OTHER; note = uracil
  modified_base 257: mod_base = OTHER; note = uracil
  modified_base 260: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 270: mod_base = OTHER; note = uracil
  modified_base 279: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 298: mod_base = OTHER; note = uracil
  modified_base 299: mod_base = OTHER; note = uracil
tyggaaatgaattyggtygggtttttagtttggygggygagttaggttygatagtttygygtygggygagyggaggatttatygttygttygtygtttatttygggggttttattyggttygattgtagtttttttttttggtataggyggttgaggaaggatttttgttygyggtatagygtttgtygggtggttaggaatatygtgttttttaygttgagtygtatttatttgttttagtygtttgyggygyggtygttygttttygtyggyggygttgttttttyggtttttatttt

SEQ ID NO: 433 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 17: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 30: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 44: mod_base = OTHER; note = uracil
  modified_base 51: mod_base = OTHER; note = uracil
  modified_base 54: mod_base = OTHER; note = uracil
  modified_base 59: mod_base = OTHER; note = uracil
  modified_base 68: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 76: mod_base = OTHER; note = uracil
  modified_base 81: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 113: mod_base = OTHER; note = uracil
  modified_base 114: mod_base = OTHER; note = uracil
  modified_base 120: mod_base = OTHER; note = uracil
  modified_base 122: mod_base = OTHER; note = uracil
  modified_base 124: mod_base = OTHER; note = uracil
  modified_base 142: mod_base = OTHER; note = uracil
  modified_base 160: mod_base = OTHER; note = uracil
  modified_base 162: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 179: mod_base = OTHER; note = uracil
  modified_base 180: mod_base = OTHER; note = uracil
  modified_base 183: mod_base = OTHER; note = uracil
  modified_base 194: mod_base = OTHER; note = uracil
  modified_base 195: mod_base = OTHER; note = uracil
  modified_base 199: mod_base = OTHER; note = uracil
  modified_base 201: mod_base = OTHER; note = uracil
  modified_base 207: mod_base = OTHER; note = uracil
  modified_base 222: mod_base = OTHER; note = uracil
  modified_base 227: mod_base = OTHER; note = uracil
  modified_base 234: mod_base = OTHER; note = uracil
  modified_base 245: mod_base = OTHER; note = uracil
  modified_base 246: mod_base = OTHER; note = uracil
  modified_base 249: mod_base = OTHER; note = uracil
  modified_base 255: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 287: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 296: mod_base = OTHER; note = uracil
  modified_base 297: mod_base = OTHER; note = uracil
  modified_base 299: mod_base = OTHER; note = uracil
tttattgatgyggagatygagttttagggtagtagagttttagtttygygttatayggttgtgggygttgygttttagggtayggtyggtttaggtygtggtttattygggattygyggtttatyggtgyggttgaygyggtaygggaagyggtaggtgtttagtatttttttttygttttgttygtygatgattyggtattggygtagatayggygtgagtttggtygggtttagggygygagttagtygatgtyggaygttttygattygtttttatagygygttttttttygtttta

SEQ ID NO: 434 - DNA, 300 bp, synthetic construct
  misc_feature 1..300: note = Synthetic polynucleotide
  source 1..300: mol_type = other DNA
  modified_base 20: mod_base = OTHER; note = uracil
  modified_base 43: mod_base = OTHER; note = uracil
  modified_base 47: mod_base = OTHER; note = uracil
  modified_base 53: mod_base = OTHER; note = uracil
  modified_base 57: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 82: mod_base = OTHER; note = uracil
  modified_base 86: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 103: mod_base = OTHER; note = uracil
  modified_base 109: mod_base = OTHER; note = uracil
  modified_base 119: mod_base = OTHER; note = uracil
  modified_base 137: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 151: mod_base = OTHER; note = uracil
  modified_base 154: mod_base = OTHER; note = uracil
  modified_base 155: mod_base = OTHER; note = uracil
  modified_base 160: mod_base = OTHER; note = uracil
  modified_base 166: mod_base = OTHER; note = uracil
  modified_base 169: mod_base = OTHER; note = uracil
  modified_base 172: mod_base = OTHER; note = uracil
  modified_base 174: mod_base = OTHER; note = uracil
  modified_base 182: mod_base = OTHER; note = uracil
  modified_base 190: mod_base = OTHER; note = uracil
  modified_base 191: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 212: mod_base = OTHER; note = uracil
  modified_base 216: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 231: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 258: mod_base = OTHER; note = uracil
  modified_base 264: mod_base = OTHER; note = uracil
  modified_base 266: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 280: mod_base = OTHER; note = uracil
  modified_base 286: mod_base = OTHER; note = uracil
  modified_base 288: mod_base = OTHER; note = uracil
  modified_base 291: mod_base = OTHER; note = uracil
  modified_base 294: mod_base = OTHER; note = uracil
tgaggyggaggaggaygygttgtgggagygaatygagggygttyggtatyggttggttygygttttgaattyggttaagtttaygtygtatttgygttagtgtygggttatygaygagtaggaygaggaggaggtgttgagtatttatygtttttygtgtygygttaatygtatyggtgagtygygggtttygagtgggttaygatttgggtyggtygtgttttggggygtagygtttatagtygtgtagygygaagttagggttttgttgttttggggttyggttttygtattagtaga

SEQ ID NO: 435 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 10: mod_base = OTHER; note = uracil
  modified_base 11: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 31: mod_base = OTHER; note = uracil
  modified_base 34: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 49: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 82: mod_base = OTHER; note = uracil
  modified_base 87: mod_base = OTHER; note = uracil
  modified_base 92: mod_base = OTHER; note = uracil
  modified_base 93: mod_base = OTHER; note = uracil
  modified_base 96: mod_base = OTHER; note = uracil
  modified_base 99: mod_base = OTHER; note = uracil
  modified_base 101: mod_base = OTHER; note = uracil
  modified_base 113: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 123: mod_base = OTHER; note = uracil
  modified_base 129: mod_base = OTHER; note = uracil
  modified_base 133: mod_base = OTHER; note = uracil
  modified_base 139: mod_base = OTHER; note = uracil
  modified_base 142: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 167: mod_base = OTHER; note = uracil
  modified_base 171: mod_base = OTHER; note = uracil
  modified_base 174: mod_base = OTHER; note = uracil
  modified_base 177: mod_base = OTHER; note = uracil
  modified_base 181: mod_base = OTHER; note = uracil
  modified_base 186: mod_base = OTHER; note = uracil
  modified_base 199: mod_base = OTHER; note = uracil
  modified_base 202: mod_base = OTHER; note = uracil
  modified_base 215: mod_base = OTHER; note = uracil
  modified_base 218: mod_base = OTHER; note = uracil
  modified_base 220: mod_base = OTHER; note = uracil
  modified_base 232: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 240: mod_base = OTHER; note = uracil
  modified_base 246: mod_base = OTHER; note = uracil
  modified_base 247: mod_base = OTHER; note = uracil
  modified_base 254: mod_base = OTHER; note = uracil
  modified_base 265: mod_base = OTHER; note = uracil
  modified_base 266: mod_base = OTHER; note = uracil
  modified_base 270: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 287: mod_base = OTHER; note = uracil
  modified_base 294: mod_base = OTHER; note = uracil
  modified_base 297: mod_base = OTHER; note = uracil
  modified_base 298: mod_base = OTHER; note = uracil
tttattttttttagtttagaaaattttttattgtttttttaatggaggttgttttaggagtggtttagtggggttaattagttgttttatgttagtagtttyggagtatgtatatttttattttggtttaaatttgtttttttatttayggttttattaagaaaaatatttatttgtaggttggatygggttgggatgtagtaagttggtgtggttatttygagtgtgtgatatatttgtaggggtttgtgagtagtgggagggttagatatgtggatttttagggttggtggttttttt

SEQ ID NO: 436 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 10: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 24: mod_base = OTHER; note = uracil
  modified_base 25: mod_base = OTHER; note = uracil
  modified_base 27: mod_base = OTHER; note = uracil
  modified_base 32: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 44: mod_base = OTHER; note = uracil
  modified_base 47: mod_base = OTHER; note = uracil
  modified_base 49: mod_base = OTHER; note = uracil
  modified_base 51: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 70: mod_base = OTHER; note = uracil
  modified_base 72: mod_base = OTHER; note = uracil
  modified_base 74: mod_base = OTHER; note = uracil
  modified_base 76: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 95: mod_base = OTHER; note = uracil
  modified_base 99: mod_base = OTHER; note = uracil
  modified_base 102: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 111: mod_base = OTHER; note = uracil
  modified_base 116: mod_base = OTHER; note = uracil
  modified_base 117: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 139: mod_base = OTHER; note = uracil
  modified_base 149: mod_base = OTHER; note = uracil
  modified_base 164: mod_base = OTHER; note = uracil
  modified_base 174: mod_base = OTHER; note = uracil
  modified_base 175: mod_base = OTHER; note = uracil
  modified_base 190: mod_base = OTHER; note = uracil
  modified_base 194: mod_base = OTHER; note = uracil
  modified_base 196: mod_base = OTHER; note = uracil
  modified_base 202: mod_base = OTHER; note = uracil
  modified_base 205: mod_base = OTHER; note = uracil
  modified_base 209: mod_base = OTHER; note = uracil
  modified_base 216: mod_base = OTHER; note = uracil
  modified_base 219: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 232: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 267: mod_base = OTHER; note = uracil
  modified_base 281: mod_base = OTHER; note = uracil
  modified_base 286: mod_base = OTHER; note = uracil
aggaagttattagttttgggaatttatatgtttggtttttttattgtttataggtttttgtaggtgtgttatatattyggagtagttatattaatttgttgtattttaattyggtttagtttgtagatgaatgttttttttaatggggtygtgaatagaagaataagtttgaattagagtggaaatgtatatatttyggagttgttggtatagaatagttggttggttttattgggttatttttggggtagtttttattggggaagtagtgagggattttttaaattaggaaaggtgaga

SEQ ID NO: 437 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 9: mod_base = OTHER; note = uracil
  modified_base 12: mod_base = OTHER; note = uracil
  modified_base 16: mod_base = OTHER; note = uracil
  modified_base 24: mod_base = OTHER; note = uracil
  modified_base 31: mod_base = OTHER; note = uracil
  modified_base 36: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 52: mod_base = OTHER; note = uracil
  modified_base 56: mod_base = OTHER; note = uracil
  modified_base 64: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 81: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 96: mod_base = OTHER; note = uracil
  modified_base 99: mod_base = OTHER; note = uracil
  modified_base 103: mod_base = OTHER; note = uracil
  modified_base 105: mod_base = OTHER; note = uracil
  modified_base 109: mod_base = OTHER; note = uracil
  modified_base 120: mod_base = OTHER; note = uracil
  modified_base 121: mod_base = OTHER; note = uracil
  modified_base 127: mod_base = OTHER; note = uracil
  modified_base 128: mod_base = OTHER; note = uracil
  modified_base 135: mod_base = OTHER; note = uracil
  modified_base 141: mod_base = OTHER; note = uracil
  modified_base 147: mod_base = OTHER; note = uracil
  modified_base 149: mod_base = OTHER; note = uracil
  modified_base 154: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 166: mod_base = OTHER; note = uracil
  modified_base 168: mod_base = OTHER; note = uracil
  modified_base 170: mod_base = OTHER; note = uracil
  modified_base 178: mod_base = OTHER; note = uracil
  modified_base 191: mod_base = OTHER; note = uracil
  modified_base 193: mod_base = OTHER; note = uracil
  modified_base 200: mod_base = OTHER; note = uracil
  modified_base 201: mod_base = OTHER; note = uracil
  modified_base 215: mod_base = OTHER; note = uracil
  modified_base 216: mod_base = OTHER; note = uracil
  modified_base 219: mod_base = OTHER; note = uracil
  modified_base 225: mod_base = OTHER; note = uracil
  modified_base 228: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 246: mod_base = OTHER; note = uracil
  modified_base 249: mod_base = OTHER; note = uracil
  modified_base 258: mod_base = OTHER; note = uracil
  modified_base 269: mod_base = OTHER; note = uracil
  modified_base 282: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 297: mod_base = OTHER; note = uracil
  modified_base 298: mod_base = OTHER; note = uracil
aaygttgatattttttygggtgtttgaaaatagaattggtttttttaagaattaataaygatattgtttttagttaygttttttttttgtttttgttataygttttgttaaataggtggttagaggttygggtgtagatgtagtggtttaygttagtaattttagtattttgggaggttggtgggyggattatttgaggttaggagtttaaagattagtttgggtaatatggtgaaattttgtttttattaaaaatataaaaaattagtygggtgtggtggtataaatttgtagttttag

SEQ ID NO: 438 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 10: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 33: mod_base = OTHER; note = uracil
  modified_base 59: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 88: mod_base = OTHER; note = uracil
  modified_base 95: mod_base = OTHER; note = uracil
  modified_base 97: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 136: mod_base = OTHER; note = uracil
  modified_base 145: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 161: mod_base = OTHER; note = uracil
  modified_base 164: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 186: mod_base = OTHER; note = uracil
  modified_base 194: mod_base = OTHER; note = uracil
  modified_base 206: mod_base = OTHER; note = uracil
  modified_base 212: mod_base = OTHER; note = uracil
  modified_base 228: mod_base = OTHER; note = uracil
  modified_base 235: mod_base = OTHER; note = uracil
  modified_base 252: mod_base = OTHER; note = uracil
  modified_base 262: mod_base = OTHER; note = uracil
  modified_base 263: mod_base = OTHER; note = uracil
  modified_base 268: mod_base = OTHER; note = uracil
  modified_base 275: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 294: mod_base = OTHER; note = uracil
ttggaattataggtttgtgttattatattyggttaattttttgtatttttagtagagatagggttttattatgttgtttaagttggtttttaaatttttggttttaagtgattygtttattagttttttagagtgttgggattattgaygtgagttattgtatttgtattygggtttttggttatttatttgatagagygtgtagtaagaataggaagggaaygtggttgaaaatagtatygttgttagtttttaggaaggttagttttgtttttagatattyggaaagatgttagygtt

SEQ ID NO: 439 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 22: mod_base = OTHER; note = uracil
  modified_base 24: mod_base = OTHER; note = uracil
  modified_base 32: mod_base = OTHER; note = uracil
  modified_base 35: mod_base = OTHER; note = uracil
  modified_base 43: mod_base = OTHER; note = uracil
  modified_base 44: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 54: mod_base = OTHER; note = uracil
  modified_base 62: mod_base = OTHER; note = uracil
  modified_base 64: mod_base = OTHER; note = uracil
  modified_base 68: mod_base = OTHER; note = uracil
  modified_base 69: mod_base = OTHER; note = uracil
  modified_base 75: mod_base = OTHER; note = uracil
  modified_base 78: mod_base = OTHER; note = uracil
  modified_base 81: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 92: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 120: mod_base = OTHER; note = uracil
  modified_base 121: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 134: mod_base = OTHER; note = uracil
  modified_base 136: mod_base = OTHER; note = uracil
  modified_base 139: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 178: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 198: mod_base = OTHER; note = uracil
  modified_base 200: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 221: mod_base = OTHER; note = uracil
  modified_base 228: mod_base = OTHER; note = uracil
  modified_base 233: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 248: mod_base = OTHER; note = uracil
  modified_base 253: mod_base = OTHER; note = uracil
  modified_base 261: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 282: mod_base = OTHER; note = uracil
  modified_base 288: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 297: mod_base = OTHER; note = uracil
  modified_base 298: mod_base = OTHER; note = uracil
  modified_base 299: mod_base = OTHER; note = uracil
gaggtttatttaygtttttagtttaygatatttgtagagatgttaaattttggtagaggaatttaggttatgtgttttagttgtttttttatttttttattttttgttygggttttgagttaggagttaggtatatagttggatttattygttaatgttatttatttttgtgtttagtattyggtttayggtaggtgtttagtgtgtaggtttatatgtattaggtgtaaggtaaygatatattatataggataaggatgtaaagtattttttgggtttttttgyggttttgttttttta

SEQ ID NO: 440 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 14: mod_base = OTHER; note = uracil
  modified_base 17: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 36: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 51: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 83: mod_base = OTHER; note = uracil
  modified_base 91: mod_base = OTHER; note = uracil
  modified_base 92: mod_base = OTHER; note = uracil
  modified_base 95: mod_base = OTHER; note = uracil
  modified_base 97: mod_base = OTHER; note = uracil
  modified_base 99: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 110: mod_base = OTHER; note = uracil
  modified_base 117: mod_base = OTHER; note = uracil
  modified_base 124: mod_base = OTHER; note = uracil
  modified_base 129: mod_base = OTHER; note = uracil
  modified_base 131: mod_base = OTHER; note = uracil
  modified_base 144: mod_base = OTHER; note = uracil
  modified_base 159: mod_base = OTHER; note = uracil
  modified_base 160: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 184: mod_base = OTHER; note = uracil
  modified_base 189: mod_base = OTHER; note = uracil
  modified_base 190: mod_base = OTHER; note = uracil
  modified_base 195: mod_base = OTHER; note = uracil
  modified_base 218: mod_base = OTHER; note = uracil
  modified_base 221: mod_base = OTHER; note = uracil
  modified_base 227: mod_base = OTHER; note = uracil
  modified_base 229: mod_base = OTHER; note = uracil
  modified_base 234: mod_base = OTHER; note = uracil
  modified_base 235: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 259: mod_base = OTHER; note = uracil
  modified_base 262: mod_base = OTHER; note = uracil
  modified_base 264: mod_base = OTHER; note = uracil
  modified_base 267: mod_base = OTHER; note = uracil
  modified_base 280: mod_base = OTHER; note = uracil
  modified_base 297: mod_base = OTHER; note = uracil
  modified_base 298: mod_base = OTHER; note = uracil
  modified_base 300: mod_base = OTHER; note = uracil
tgggaaggtagagtygtagaagggtttagaaggtgttttgtatttttgttttgtgtggtgtgtygttgttttgtatttagtatatgtgggtttgtatattgagtatttgtygtgggtygggtgttgggtataagggtgggtggtattggyggatgggtttagttgtgtgtttggtttttggtttagggttygggtagggagtggaggagtgagggagtagttgaagtatatggtttgagtttttttgttagggtttggtatttttgtagatatygtgagttgggggygtgggtgggtttt

SEQ ID NO: 441 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 16: mod_base = OTHER; note = uracil
  modified_base 17: mod_base = OTHER; note = uracil
  modified_base 21: mod_base = OTHER; note = uracil
  modified_base 29: mod_base = OTHER; note = uracil
  modified_base 36: mod_base = OTHER; note = uracil
  modified_base 48: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 64: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 101: mod_base = OTHER; note = uracil
  modified_base 107: mod_base = OTHER; note = uracil
  modified_base 108: mod_base = OTHER; note = uracil
  modified_base 114: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 146: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 166: mod_base = OTHER; note = uracil
  modified_base 167: mod_base = OTHER; note = uracil
  modified_base 181: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 203: mod_base = OTHER; note = uracil
  modified_base 205: mod_base = OTHER; note = uracil
  modified_base 213: mod_base = OTHER; note = uracil
  modified_base 214: mod_base = OTHER; note = uracil
  modified_base 219: mod_base = OTHER; note = uracil
  modified_base 224: mod_base = OTHER; note = uracil
  modified_base 226: mod_base = OTHER; note = uracil
  modified_base 231: mod_base = OTHER; note = uracil
  modified_base 237: mod_base = OTHER; note = uracil
  modified_base 238: mod_base = OTHER; note = uracil
  modified_base 242: mod_base = OTHER; note = uracil
  modified_base 243: mod_base = OTHER; note = uracil
  modified_base 249: mod_base = OTHER; note = uracil
  modified_base 251: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 280: mod_base = OTHER; note = uracil
  modified_base 281: mod_base = OTHER; note = uracil
  modified_base 292: mod_base = OTHER; note = uracil
  modified_base 300: mod_base = OTHER; note = uracil
ggaggtaaaygggaattyggttggygggttgygagtyggtagggaygttggggtttagggttgttggatagtttygttttgtatttttttttattttttatttaattttgggttygaaatagtttygggtaattttagggygaggtagtygggaattaattttagttttgaagtaagagatagaggygtttatagaagagggttttgygygtttyggattggatatagygtagagtttattttagggatatygtaattygtaagygatttaggttygttttagggygggattygygyggt

SEQ ID NO: 442 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 12: mod_base = OTHER; note = uracil
  modified_base 13: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 28: mod_base = OTHER; note = uracil
  modified_base 29: mod_base = OTHER; note = uracil
  modified_base 37: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 66: mod_base = OTHER; note = uracil
  modified_base 68: mod_base = OTHER; note = uracil
  modified_base 73: mod_base = OTHER; note = uracil
  modified_base 79: mod_base = OTHER; note = uracil
  modified_base 80: mod_base = OTHER; note = uracil
  modified_base 84: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 106: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 122: mod_base = OTHER; note = uracil
  modified_base 124: mod_base = OTHER; note = uracil
  modified_base 128: mod_base = OTHER; note = uracil
  modified_base 131: mod_base = OTHER; note = uracil
  modified_base 136: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 172: mod_base = OTHER; note = uracil
  modified_base 173: mod_base = OTHER; note = uracil
  modified_base 179: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 220: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 266: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 278: mod_base = OTHER; note = uracil
  modified_base 281: mod_base = OTHER; note = uracil
  modified_base 288: mod_base = OTHER; note = uracil
  modified_base 289: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
gtygygyggatttygttttggagygggtttgggtygtttgygggttgyggtgtttttggaatggattttgygttgtgtttagttygggaygygtagagtttttttttgtggaygtttttgttttttattttaaggttggggttaattttygattgtttygttttgggattattyggggttatttyggatttaggattaagtgagggatggggagaggtatagggyggggttgtttagtagttttggattttagygtttttatyggttygtagttygttagtygggttttygtttgttttt

SEQ ID NO: 443 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 24: mod_base = OTHER; note = uracil
  modified_base 25: mod_base = OTHER; note = uracil
  modified_base 31: mod_base = OTHER; note = uracil
  modified_base 34: mod_base = OTHER; note = uracil
  modified_base 36: mod_base = OTHER; note = uracil
  modified_base 41: mod_base = OTHER; note = uracil
  modified_base 45: mod_base = OTHER; note = uracil
  modified_base 54: mod_base = OTHER; note = uracil
  modified_base 67: mod_base = OTHER; note = uracil
  modified_base 93: mod_base = OTHER; note = uracil
  modified_base 96: mod_base = OTHER; note = uracil
  modified_base 101: mod_base = OTHER; note = uracil
  modified_base 109: mod_base = OTHER; note = uracil
  modified_base 110: mod_base = OTHER; note = uracil
  modified_base 121: mod_base = OTHER; note = uracil
  modified_base 122: mod_base = OTHER; note = uracil
  modified_base 127: mod_base = OTHER; note = uracil
  modified_base 130: mod_base = OTHER; note = uracil
  modified_base 133: mod_base = OTHER; note = uracil
  modified_base 149: mod_base = OTHER; note = uracil
  modified_base 154: mod_base = OTHER; note = uracil
  modified_base 164: mod_base = OTHER; note = uracil
  modified_base 165: mod_base = OTHER; note = uracil
  modified_base 173: mod_base = OTHER; note = uracil
  modified_base 185: mod_base = OTHER; note = uracil
  modified_base 203: mod_base = OTHER; note = uracil
  modified_base 209: mod_base = OTHER; note = uracil
  modified_base 212: mod_base = OTHER; note = uracil
  modified_base 223: mod_base = OTHER; note = uracil
  modified_base 226: mod_base = OTHER; note = uracil
  modified_base 229: mod_base = OTHER; note = uracil
  modified_base 237: mod_base = OTHER; note = uracil
  modified_base 249: mod_base = OTHER; note = uracil
  modified_base 255: mod_base = OTHER; note = uracil
  modified_base 266: mod_base = OTHER; note = uracil
  modified_base 267: mod_base = OTHER; note = uracil
  modified_base 282: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 295: mod_base = OTHER; note = uracil
  modified_base 296: mod_base = OTHER; note = uracil
tatgtgttgagatggagaaggygttagtgttagtattagataggttgagatgttaagtggaaatgttaaggaggtggtggaggtggtgggagttgtagggttgtgaggttygggagagggttagagttgtagttttaaattggagggttayggtatgtggaggttaaggaagtagatgggatgttyggggagagagtatggattgaagtagttaaagaattgtagtatttaatggataggaagaggggtagygatagygatggagtttgagaaggagggtgtagtgtttttaagttatgt

SEQ ID NO: 444 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 15: mod_base = OTHER; note = uracil
  modified_base 17: mod_base = OTHER; note = uracil
  modified_base 20: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 32: mod_base = OTHER; note = uracil
  modified_base 36: mod_base = OTHER; note = uracil
  modified_base 38: mod_base = OTHER; note = uracil
  modified_base 39: mod_base = OTHER; note = uracil
  modified_base 44: mod_base = OTHER; note = uracil
  modified_base 50: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 66: mod_base = OTHER; note = uracil
  modified_base 67: mod_base = OTHER; note = uracil
  modified_base 76: mod_base = OTHER; note = uracil
  modified_base 79: mod_base = OTHER; note = uracil
  modified_base 84: mod_base = OTHER; note = uracil
  modified_base 90: mod_base = OTHER; note = uracil
  modified_base 93: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 109: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 126: mod_base = OTHER; note = uracil
  modified_base 129: mod_base = OTHER; note = uracil
  modified_base 132: mod_base = OTHER; note = uracil
  modified_base 133: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 169: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 193: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 206: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 230: mod_base = OTHER; note = uracil
  modified_base 231: mod_base = OTHER; note = uracil
  modified_base 236: mod_base = OTHER; note = uracil
  modified_base 241: mod_base = OTHER; note = uracil
  modified_base 242: mod_base = OTHER; note = uracil
  modified_base 244: mod_base = OTHER; note = uracil
  modified_base 249: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 262: mod_base = OTHER; note = uracil
  modified_base 268: mod_base = OTHER; note = uracil
  modified_base 272: mod_base = OTHER; note = uracil
  modified_base 274: mod_base = OTHER; note = uracil
  modified_base 280: mod_base = OTHER; note = uracil
  modified_base 281: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 290: mod_base = OTHER; note = uracil
  modified_base 292: mod_base = OTHER; note = uracil
  modified_base 295: mod_base = OTHER; note = uracil
  modified_base 297: mod_base = OTHER; note = uracil
atatggtttggggatattgtatttttttttttaggttttatygttgtygttgtttttttttttgtttattagatgttgtaattttttagttgttttagtttatatttttttttyggatattttatttgtttttttggtttttatatgtygtgattttttaatttaaagttgtagttttggttttttttygggttttatagttttgtagtttttattatttttattatttttttgatatttttatttgatattttagtttgtttagtgttgatattggygttttttttattttagtatatg

SEQ ID NO: 445 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 5: mod_base = OTHER; note = uracil
  modified_base 17: mod_base = OTHER; note = uracil
  modified_base 23: mod_base = OTHER; note = uracil
  modified_base 26: mod_base = OTHER; note = uracil
  modified_base 36: mod_base = OTHER; note = uracil
  modified_base 41: mod_base = OTHER; note = uracil
  modified_base 42: mod_base = OTHER; note = uracil
  modified_base 45: mod_base = OTHER; note = uracil
  modified_base 48: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 60: mod_base = OTHER; note = uracil
  modified_base 61: mod_base = OTHER; note = uracil
  modified_base 66: mod_base = OTHER; note = uracil
  modified_base 70: mod_base = OTHER; note = uracil
  modified_base 71: mod_base = OTHER; note = uracil
  modified_base 76: mod_base = OTHER; note = uracil
  modified_base 79: mod_base = OTHER; note = uracil
  modified_base 81: mod_base = OTHER; note = uracil
  modified_base 83: mod_base = OTHER; note = uracil
  modified_base 93: mod_base = OTHER; note = uracil
  modified_base 96: mod_base = OTHER; note = uracil
  modified_base 98: mod_base = OTHER; note = uracil
  modified_base 107: mod_base = OTHER; note = uracil
  modified_base 112: mod_base = OTHER; note = uracil
  modified_base 113: mod_base = OTHER; note = uracil
  modified_base 118: mod_base = OTHER; note = uracil
  modified_base 126: mod_base = OTHER; note = uracil
  modified_base 128: mod_base = OTHER; note = uracil
  modified_base 130: mod_base = OTHER; note = uracil
  modified_base 134: mod_base = OTHER; note = uracil
  modified_base 137: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 160: mod_base = OTHER; note = uracil
  modified_base 161: mod_base = OTHER; note = uracil
  modified_base 162: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 182: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 198: mod_base = OTHER; note = uracil
  modified_base 208: mod_base = OTHER; note = uracil
  modified_base 214: mod_base = OTHER; note = uracil
  modified_base 218: mod_base = OTHER; note = uracil
  modified_base 225: mod_base = OTHER; note = uracil
  modified_base 232: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 249: mod_base = OTHER; note = uracil
  modified_base 259: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 282: mod_base = OTHER; note = uracil
tttttaggtttggtttttgttgtygttgttgtttttttttttaatattataagttttttttttatttttttatgtttgtatataggaagyggtattatttgttttttatgttttgygtatygaggtatattttttgtttttttttgtgtygttagtyggtttaggtttatagatggtaggatttgtgttttaggttgttgtgtgagttagagttaggtaggaagtaaatggtaattttatygyggtgattgaggaatgtttaaygaaggygtygtttttgataayggtgtgggttggtaa

SEQ ID NO: 446 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 12: mod_base = OTHER; note = uracil
  modified_base 14: mod_base = OTHER; note = uracil
  modified_base 21: mod_base = OTHER; note = uracil
  modified_base 32: mod_base = OTHER; note = uracil
  modified_base 33: mod_base = OTHER; note = uracil
  modified_base 43: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 54: mod_base = OTHER; note = uracil
  modified_base 56: mod_base = OTHER; note = uracil
  modified_base 70: mod_base = OTHER; note = uracil
  modified_base 71: mod_base = OTHER; note = uracil
  modified_base 77: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 89: mod_base = OTHER; note = uracil
  modified_base 91: mod_base = OTHER; note = uracil
  modified_base 95: mod_base = OTHER; note = uracil
  modified_base 97: mod_base = OTHER; note = uracil
  modified_base 99: mod_base = OTHER; note = uracil
  modified_base 101: mod_base = OTHER; note = uracil
  modified_base 104: mod_base = OTHER; note = uracil
  modified_base 107: mod_base = OTHER; note = uracil
  modified_base 108: mod_base = OTHER; note = uracil
  modified_base 114: mod_base = OTHER; note = uracil
  modified_base 116: mod_base = OTHER; note = uracil
  modified_base 121: mod_base = OTHER; note = uracil
  modified_base 122: mod_base = OTHER; note = uracil
  modified_base 125: mod_base = OTHER; note = uracil
  modified_base 126: mod_base = OTHER; note = uracil
  modified_base 129: mod_base = OTHER; note = uracil
  modified_base 136: mod_base = OTHER; note = uracil
  modified_base 137: mod_base = OTHER; note = uracil
  modified_base 142: mod_base = OTHER; note = uracil
  modified_base 146: mod_base = OTHER; note = uracil
  modified_base 153: mod_base = OTHER; note = uracil
  modified_base 155: mod_base = OTHER; note = uracil
  modified_base 165: mod_base = OTHER; note = uracil
  modified_base 176: mod_base = OTHER; note = uracil
  modified_base 177: mod_base = OTHER; note = uracil
  modified_base 186: mod_base = OTHER; note = uracil
  modified_base 191: mod_base = OTHER; note = uracil
  modified_base 200: mod_base = OTHER; note = uracil
  modified_base 209: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 223: mod_base = OTHER; note = uracil
  modified_base 227: mod_base = OTHER; note = uracil
  modified_base 248: mod_base = OTHER; note = uracil
  modified_base 270: mod_base = OTHER; note = uracil
  modified_base 273: mod_base = OTHER; note = uracil
  modified_base 279: mod_base = OTHER; note = uracil
  modified_base 282: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 294: mod_base = OTHER; note = uracil
ttattaatttatatygttgttaagggyggygttttygttaagtattttttagttatygyggtgaagttgttatttgttttttgtttgattttgatttatatagtagtttggggtataagttttattatttgtgggtttgggtyggttggyggtataaagaggagtagaaagtgtgtttygatgygtaggatatgaaaaataagtgatgtygttttttgtgtgtagatatggaaagataaggaagaggtttatgatgttggaaaagaaaataatagyggtaatagaaattaaatttgaggg

SEQ ID NO: 447 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 15: mod_base = OTHER; note = uracil
  modified_base 18: mod_base = OTHER; note = uracil
  modified_base 19: mod_base = OTHER; note = uracil
  modified_base 22: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 48: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 64: mod_base = OTHER; note = uracil
  modified_base 74: mod_base = OTHER; note = uracil
  modified_base 80: mod_base = OTHER; note = uracil
  modified_base 84: mod_base = OTHER; note = uracil
  modified_base 91: mod_base = OTHER; note = uracil
  modified_base 98: mod_base = OTHER; note = uracil
  modified_base 101: mod_base = OTHER; note = uracil
  modified_base 104: mod_base = OTHER; note = uracil
  modified_base 106: mod_base = OTHER; note = uracil
  modified_base 115: mod_base = OTHER; note = uracil
  modified_base 125: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 148: mod_base = OTHER; note = uracil
  modified_base 174: mod_base = OTHER; note = uracil
  modified_base 177: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 194: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 215: mod_base = OTHER; note = uracil
  modified_base 219: mod_base = OTHER; note = uracil
  modified_base 224: mod_base = OTHER; note = uracil
  modified_base 231: mod_base = OTHER; note = uracil
  modified_base 237: mod_base = OTHER; note = uracil
  modified_base 239: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 258: mod_base = OTHER; note = uracil
  modified_base 263: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 286: mod_base = OTHER; note = uracil
  modified_base 287: mod_base = OTHER; note = uracil
  modified_base 294: mod_base = OTHER; note = uracil
  modified_base 299: mod_base = OTHER; note = uracil
tgtttttttttgtgtygttagtyggtttaggtttatagatggtaggatttgtgttttaggttgttgtgtgagttagagttaggtaggaagtaaatggtaattttatygyggtgattgaggaatgtttaaygaaggygtygtttttgataayggtgtgggttggtaaaaggaaatagtygggagttttgtagygtyggtgtygttatygtttagtttgattgtgtatttgattaagttataagaggttaggtttgtgatttgttygagggaaaaattattagaaaattaggtgtttgggtt

SEQ ID NO: 448 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 9: mod_base = OTHER; note = uracil
  modified_base 11: mod_base = OTHER; note = uracil
  modified_base 12: mod_base = OTHER; note = uracil
  modified_base 20: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 40: mod_base = OTHER; note = uracil
  modified_base 45: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 66: mod_base = OTHER; note = uracil
  modified_base 72: mod_base = OTHER; note = uracil
  modified_base 78: mod_base = OTHER; note = uracil
  modified_base 80: mod_base = OTHER; note = uracil
  modified_base 84: mod_base = OTHER; note = uracil
  modified_base 88: mod_base = OTHER; note = uracil
  modified_base 102: mod_base = OTHER; note = uracil
  modified_base 104: mod_base = OTHER; note = uracil
  modified_base 110: mod_base = OTHER; note = uracil
  modified_base 113: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 125: mod_base = OTHER; note = uracil
  modified_base 131: mod_base = OTHER; note = uracil
  modified_base 132: mod_base = OTHER; note = uracil
  modified_base 138: mod_base = OTHER; note = uracil
  modified_base 139: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 148: mod_base = OTHER; note = uracil
  modified_base 155: mod_base = OTHER; note = uracil
  modified_base 166: mod_base = OTHER; note = uracil
  modified_base 167: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 188: mod_base = OTHER; note = uracil
  modified_base 190: mod_base = OTHER; note = uracil
  modified_base 204: mod_base = OTHER; note = uracil
  modified_base 205: mod_base = OTHER; note = uracil
  modified_base 211: mod_base = OTHER; note = uracil
  modified_base 214: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 225: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 235: mod_base = OTHER; note = uracil
  modified_base 238: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 250: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 260: mod_base = OTHER; note = uracil
  modified_base 263: mod_base = OTHER; note = uracil
  modified_base 270: mod_base = OTHER; note = uracil
  modified_base 271: mod_base = OTHER; note = uracil
  modified_base 276: mod_base = OTHER; note = uracil
  modified_base 280: mod_base = OTHER; note = uracil
  modified_base 287: mod_base = OTHER; note = uracil
  modified_base 289: mod_base = OTHER; note = uracil
  modified_base 299: mod_base = OTHER; note = uracil
agtttagatatttggttttttggtggtttttttttyggataagttataggtttggttttttgtgatttagttaaatgtatagttagattaaayggtggyggtatyggygttgtagggttttyggttgtttttttttattaatttatatygttgttaagggyggygttttygttaagtattttttagttatygyggtgaagttgttatttgttttttgtttgattttgatttatatagtagtttggggtataagttttattatttgtgggtttgggtyggttggyggtataaagaggagta

SEQ ID NO: 449 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 6: mod_base = OTHER; note = uracil
  modified_base 8: mod_base = OTHER; note = uracil
  modified_base 14: mod_base = OTHER; note = uracil
  modified_base 15: mod_base = OTHER; note = uracil
  modified_base 17: mod_base = OTHER; note = uracil
  modified_base 20: mod_base = OTHER; note = uracil
  modified_base 25: mod_base = OTHER; note = uracil
  modified_base 41: mod_base = OTHER; note = uracil
  modified_base 44: mod_base = OTHER; note = uracil
  modified_base 47: mod_base = OTHER; note = uracil
  modified_base 53: mod_base = OTHER; note = uracil
  modified_base 56: mod_base = OTHER; note = uracil
  modified_base 65: mod_base = OTHER; note = uracil
  modified_base 70: mod_base = OTHER; note = uracil
  modified_base 72: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 86: mod_base = OTHER; note = uracil
  modified_base 91: mod_base = OTHER; note = uracil
  modified_base 110: mod_base = OTHER; note = uracil
  modified_base 116: mod_base = OTHER; note = uracil
  modified_base 120: mod_base = OTHER; note = uracil
  modified_base 121: mod_base = OTHER; note = uracil
  modified_base 126: mod_base = OTHER; note = uracil
  modified_base 132: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 148: mod_base = OTHER; note = uracil
  modified_base 154: mod_base = OTHER; note = uracil
  modified_base 164: mod_base = OTHER; note = uracil
  modified_base 168: mod_base = OTHER; note = uracil
  modified_base 170: mod_base = OTHER; note = uracil
  modified_base 172: mod_base = OTHER; note = uracil
  modified_base 177: mod_base = OTHER; note = uracil
  modified_base 178: mod_base = OTHER; note = uracil
  modified_base 192: mod_base = OTHER; note = uracil
  modified_base 197: mod_base = OTHER; note = uracil
  modified_base 199: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 214: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 227: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 243: mod_base = OTHER; note = uracil
  modified_base 245: mod_base = OTHER; note = uracil
  modified_base 248: mod_base = OTHER; note = uracil
  modified_base 252: mod_base = OTHER; note = uracil
  modified_base 253: mod_base = OTHER; note = uracil
  modified_base 265: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 287: mod_base = OTHER; note = uracil
  modified_base 291: mod_base = OTHER; note = uracil
  modified_base 292: mod_base = OTHER; note = uracil
ttgtgtttaagagttattttttaatyggggtgggaggaagtagttttaggaattgttgagagagtagaatttaygttttagggtttagagtaggaggtagggtgtgyggtaagygttggttyggatagaagtagagtgggttttggtttygggtaggatgtttttgatttatattttttgaggagagaaagttaagttttttgtttaatgtttttgtttttttttttagaaaaatgttttagttttttyggtttgaaggaatggttttttttygggttttatgatttttttttgtgtggg

SEQ ID NO: 450 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 5: mod_base = OTHER; note = uracil
  modified_base 7: mod_base = OTHER; note = uracil
  modified_base 18: mod_base = OTHER; note = uracil
  modified_base 25: mod_base = OTHER; note = uracil
  modified_base 26: mod_base = OTHER; note = uracil
  modified_base 37: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 46: mod_base = OTHER; note = uracil
  modified_base 50: mod_base = OTHER; note = uracil
  modified_base 59: mod_base = OTHER; note = uracil
  modified_base 65: mod_base = OTHER; note = uracil
  modified_base 72: mod_base = OTHER; note = uracil
  modified_base 85: mod_base = OTHER; note = uracil
  modified_base 91: mod_base = OTHER; note = uracil
  modified_base 98: mod_base = OTHER; note = uracil
  modified_base 105: mod_base = OTHER; note = uracil
  modified_base 110: mod_base = OTHER; note = uracil
  modified_base 114: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 135: mod_base = OTHER; note = uracil
  modified_base 141: mod_base = OTHER; note = uracil
  modified_base 144: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 167: mod_base = OTHER; note = uracil
  modified_base 170: mod_base = OTHER; note = uracil
  modified_base 173: mod_base = OTHER; note = uracil
  modified_base 177: mod_base = OTHER; note = uracil
  modified_base 182: mod_base = OTHER; note = uracil
  modified_base 183: mod_base = OTHER; note = uracil
  modified_base 188: mod_base = OTHER; note = uracil
  modified_base 192: mod_base = OTHER; note = uracil
  modified_base 195: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 213: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 234: mod_base = OTHER; note = uracil
  modified_base 237: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 251: mod_base = OTHER; note = uracil
  modified_base 252: mod_base = OTHER; note = uracil
  modified_base 258: mod_base = OTHER; note = uracil
  modified_base 261: mod_base = OTHER; note = uracil
  modified_base 264: mod_base = OTHER; note = uracil
  modified_base 265: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 288: mod_base = OTHER; note = uracil
  modified_base 290: mod_base = OTHER; note = uracil
  modified_base 296: mod_base = OTHER; note = uracil
  modified_base 298: mod_base = OTHER; note = uracil
tttatataggaaagaattatggggttygggaggaggttatttttttaggtyggaagagttgaggtatttttttggaaggggagatagagatattaggtaaagagtttagttttttttttttaggaaatgtgagttagaaatattttgttygagattagggtttattttgtttttgttygggttagygtttgtygtatattttattttttgttttgagttttggagygtgagttttgtttttttagtagtttttgaagttgtttttttttatttyggttaagaagtggtttttgagtatag

SEQ ID NO: 451 - DNA, 300 bp, synthetic construct
  misc_feature 1..300: note = Synthetic polynucleotide
  source 1..300: mol_type = other DNA
  modified_base 15: mod_base = OTHER; note = uracil
  modified_base 21: mod_base = OTHER; note = uracil
  modified_base 25: mod_base = OTHER; note = uracil
  modified_base 27: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 47: mod_base = OTHER; note = uracil
  modified_base 59: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 71: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 91: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 124: mod_base = OTHER; note = uracil
  modified_base 130: mod_base = OTHER; note = uracil
  modified_base 133: mod_base = OTHER; note = uracil
  modified_base 137: mod_base = OTHER; note = uracil
  modified_base 139: mod_base = OTHER; note = uracil
  modified_base 141: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 156: mod_base = OTHER; note = uracil
  modified_base 194: mod_base = OTHER; note = uracil
  modified_base 196: mod_base = OTHER; note = uracil
  modified_base 205: mod_base = OTHER; note = uracil
  modified_base 206: mod_base = OTHER; note = uracil
  modified_base 215: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 228: mod_base = OTHER; note = uracil
  modified_base 229: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 262: mod_base = OTHER; note = uracil
  modified_base 271: mod_base = OTHER; note = uracil
  modified_base 281: mod_base = OTHER; note = uracil
  modified_base 282: mod_base = OTHER; note = uracil
  modified_base 284: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 294: mod_base = OTHER; note = uracil
  modified_base 295: mod_base = OTHER; note = uracil
  modified_base 298: mod_base = OTHER; note = uracil
ttttttttttgagatagagtttygttttgttatttaggttggagtgtagtggygtgatttyggtttattgtaagttttatttttygggtttatgttatttttttgttttagttttttgagtatttgggattataggtatttattattaygttyggttaattttttttttttatttttagtggagayggggttttattgtgttagttaggatggtttygattttttgatttygtgattagttygttttagttttttaaagtgttgggattataggtgtgagttattttattyggtttgtta

SEQ ID NO: 452 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 20: mod_base = OTHER; note = uracil
  modified_base 22: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 41: mod_base = OTHER; note = uracil
  modified_base 51: mod_base = OTHER; note = uracil
  modified_base 61: mod_base = OTHER; note = uracil
  modified_base 66: mod_base = OTHER; note = uracil
  modified_base 74: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 145: mod_base = OTHER; note = uracil
  modified_base 164: mod_base = OTHER; note = uracil
  modified_base 165: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 180: mod_base = OTHER; note = uracil
  modified_base 182: mod_base = OTHER; note = uracil
  modified_base 189: mod_base = OTHER; note = uracil
  modified_base 195: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 226: mod_base = OTHER; note = uracil
  modified_base 230: mod_base = OTHER; note = uracil
  modified_base 237: mod_base = OTHER; note = uracil
  modified_base 244: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 254: mod_base = OTHER; note = uracil
  modified_base 256: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 271: mod_base = OTHER; note = uracil
  modified_base 281: mod_base = OTHER; note = uracil
  modified_base 283: mod_base = OTHER; note = uracil
  modified_base 287: mod_base = OTHER; note = uracil
  modified_base 289: mod_base = OTHER; note = uracil
  modified_base 300: mod_base = OTHER; note = uracil
agtaggtygggtgaggtggtttatatttgtaattttagtattttgggaggttgaggygggttgattaygaggttaggagatygagattattttggttaatatagtgaaatttygtttttattaaaaataaaaaaaaaaaattagtygggygtggtggtgagtgtttgtagttttagatatttaggaagttgaggtaggagaatggtatgaattygggaggtggagtttgtagtgagtygagattaygttattgtattttagtttgggtgatagagygagattttgttttaaaaaaaaaat

SEQ ID NO: 453 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 7: mod_base = OTHER; note = uracil
  modified_base 21: mod_base = OTHER; note = uracil
  modified_base 28: mod_base = OTHER; note = uracil
  modified_base 42: mod_base = OTHER; note = uracil
  modified_base 49: mod_base = OTHER; note = uracil
  modified_base 55: mod_base = OTHER; note = uracil
  modified_base 59: mod_base = OTHER; note = uracil
  modified_base 69: mod_base = OTHER; note = uracil
  modified_base 71: mod_base = OTHER; note = uracil
  modified_base 73: mod_base = OTHER; note = uracil
  modified_base 82: mod_base = OTHER; note = uracil
  modified_base 90: mod_base = OTHER; note = uracil
  modified_base 99: mod_base = OTHER; note = uracil
  modified_base 102: mod_base = OTHER; note = uracil
  modified_base 104: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 126: mod_base = OTHER; note = uracil
  modified_base 136: mod_base = OTHER; note = uracil
  modified_base 137: mod_base = OTHER; note = uracil
  modified_base 154: mod_base = OTHER; note = uracil
  modified_base 156: mod_base = OTHER; note = uracil
  modified_base 159: mod_base = OTHER; note = uracil
  modified_base 161: mod_base = OTHER; note = uracil
  modified_base 174: mod_base = OTHER; note = uracil
  modified_base 179: mod_base = OTHER; note = uracil
  modified_base 183: mod_base = OTHER; note = uracil
  modified_base 184: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 202: mod_base = OTHER; note = uracil
  modified_base 205: mod_base = OTHER; note = uracil
  modified_base 207: mod_base = OTHER; note = uracil
  modified_base 226: mod_base = OTHER; note = uracil
  modified_base 231: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 267: mod_base = OTHER; note = uracil
  modified_base 271: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 294: mod_base = OTHER; note = uracil
ttgttttttttgatttttttttttgggtaggagttagaatgtaaaatatagattttatttgtataaagtatataagagatgtttgggatttggtgatgttgtatyggagattttaatttgttttttaaagtgatttttagggagtgtgaygattttaatttttttggaagtgatttgttaaattatgagttatgttgagtttagtataagtaatatgaggygaggtaaggtaagtgggtgagtaaggaggaagtagtttagatgagtyggtagagtgtttattgggagtgaggtatgatg

SEQ ID NO: 454 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 30: mod_base = OTHER; note = uracil
  modified_base 34: mod_base = OTHER; note = uracil
  modified_base 36: mod_base = OTHER; note = uracil
  modified_base 39: mod_base = OTHER; note = uracil
  modified_base 44: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 90: mod_base = OTHER; note = uracil
  modified_base 96: mod_base = OTHER; note = uracil
  modified_base 101: mod_base = OTHER; note = uracil
  modified_base 103: mod_base = OTHER; note = uracil
  modified_base 106: mod_base = OTHER; note = uracil
  modified_base 111: mod_base = OTHER; note = uracil
  modified_base 113: mod_base = OTHER; note = uracil
  modified_base 123: mod_base = OTHER; note = uracil
  modified_base 128: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 152: mod_base = OTHER; note = uracil
  modified_base 154: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 168: mod_base = OTHER; note = uracil
  modified_base 170: mod_base = OTHER; note = uracil
  modified_base 180: mod_base = OTHER; note = uracil
  modified_base 191: mod_base = OTHER; note = uracil
  modified_base 193: mod_base = OTHER; note = uracil
  modified_base 199: mod_base = OTHER; note = uracil
  modified_base 202: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 219: mod_base = OTHER; note = uracil
  modified_base 222: mod_base = OTHER; note = uracil
  modified_base 224: mod_base = OTHER; note = uracil
  modified_base 232: mod_base = OTHER; note = uracil
  modified_base 239: mod_base = OTHER; note = uracil
  modified_base 249: mod_base = OTHER; note = uracil
  modified_base 259: mod_base = OTHER; note = uracil
  modified_base 263: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 288: mod_base = OTHER; note = uracil
  modified_base 297: mod_base = OTHER; note = uracil
  modified_base 300: mod_base = OTHER; note = uracil
attatgttttatttttagtgggtattttgtyggtttatttgggttgttttttttttatttatttatttgttttgtttygttttatattatttgtgttgaatttagtatggtttatggtttgataagttatttttaaaagagttgagatygttatattttttaggaattattttgaaaaataggttgaaattttyggtgtagtattattagattttaagtattttttgtgtgttttatatagatagaatttgtattttgtattttaatttttgtttaaagaaaaaaattaaaagaggtaat

SEQ ID NO: 455 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 11: mod_base = OTHER; note = uracil
  modified_base 19: mod_base = OTHER; note = uracil
  modified_base 28: mod_base = OTHER; note = uracil
  modified_base 31: mod_base = OTHER; note = uracil
  modified_base 33: mod_base = OTHER; note = uracil
  modified_base 43: mod_base = OTHER; note = uracil
  modified_base 46: mod_base = OTHER; note = uracil
  modified_base 47: mod_base = OTHER; note = uracil
  modified_base 55: mod_base = OTHER; note = uracil
  modified_base 65: mod_base = OTHER; note = uracil
  modified_base 66: mod_base = OTHER; note = uracil
  modified_base 83: mod_base = OTHER; note = uracil
  modified_base 85: mod_base = OTHER; note = uracil
  modified_base 88: mod_base = OTHER; note = uracil
  modified_base 90: mod_base = OTHER; note = uracil
  modified_base 103: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 119: mod_base = OTHER; note = uracil
  modified_base 120: mod_base = OTHER; note = uracil
  modified_base 124: mod_base = OTHER; note = uracil
  modified_base 131: mod_base = OTHER; note = uracil
  modified_base 134: mod_base = OTHER; note = uracil
  modified_base 136: mod_base = OTHER; note = uracil
  modified_base 155: mod_base = OTHER; note = uracil
  modified_base 160: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 196: mod_base = OTHER; note = uracil
  modified_base 200: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 223: mod_base = OTHER; note = uracil
  modified_base 237: mod_base = OTHER; note = uracil
  modified_base 251: mod_base = OTHER; note = uracil
  modified_base 259: mod_base = OTHER; note = uracil
  modified_base 261: mod_base = OTHER; note = uracil
  modified_base 263: mod_base = OTHER; note = uracil
  modified_base 265: mod_base = OTHER; note = uracil
  modified_base 269: mod_base = OTHER; note = uracil
  modified_base 276: mod_base = OTHER; note = uracil
  modified_base 277: mod_base = OTHER; note = uracil
  modified_base 281: mod_base = OTHER; note = uracil
  modified_base 284: mod_base = OTHER; note = uracil
  modified_base 286: mod_base = OTHER; note = uracil
  modified_base 287: mod_base = OTHER; note = uracil
  modified_base 298: mod_base = OTHER; note = uracil
  modified_base 300: mod_base = OTHER; note = uracil
ataagagatgtttgggatttggtgatgttgtatyggagattttaatttgttttttaaagtgatttttagggagtgtgaygattttaatttttttggaagtgatttgttaaattatgagttatgttgagtttagtataagtaatatgaggygaggtaaggtaagtgggtgagtaaggaggaagtagtttagatgagtyggtagagtgtttattgggagtgaggtatgatgaggattattygtygtgggaggtatgagggtattttttggtaaggttttttgtattattaaaatgaggttat

SEQ ID NO: 456 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 7: mod_base = OTHER; note = uracil
  modified_base 20: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 74: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 83: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 110: mod_base = OTHER; note = uracil
  modified_base 115: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 125: mod_base = OTHER; note = uracil
  modified_base 129: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 154: mod_base = OTHER; note = uracil
  modified_base 161: mod_base = OTHER; note = uracil
  modified_base 167: mod_base = OTHER; note = uracil
  modified_base 172: mod_base = OTHER; note = uracil
  modified_base 174: mod_base = OTHER; note = uracil
  modified_base 177: mod_base = OTHER; note = uracil
  modified_base 182: mod_base = OTHER; note = uracil
  modified_base 184: mod_base = OTHER; note = uracil
  modified_base 194: mod_base = OTHER; note = uracil
  modified_base 199: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 223: mod_base = OTHER; note = uracil
  modified_base 225: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 239: mod_base = OTHER; note = uracil
  modified_base 241: mod_base = OTHER; note = uracil
  modified_base 251: mod_base = OTHER; note = uracil
  modified_base 262: mod_base = OTHER; note = uracil
  modified_base 264: mod_base = OTHER; note = uracil
  modified_base 270: mod_base = OTHER; note = uracil
  modified_base 273: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 290: mod_base = OTHER; note = uracil
  modified_base 293: mod_base = OTHER; note = uracil
  modified_base 295: mod_base = OTHER; note = uracil
tgattttattttggtgatgtaaggaattttgttagagagtgtttttatgttttttaygaygagtaatttttattatgttttatttttagtgggtattttgtyggtttatttgggttgttttttttttatttatttatttgttttgtttygttttatattatttgtgttgaatttagtatggtttatggtttgataagttatttttaaaagagttgagatygttatattttttaggaattattttgaaaaataggttgaaattttyggtgtagtattattagattttaagtattttttgtg

SEQ ID NO: 457 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 36: mod_base = OTHER; note = uracil
  modified_base 44: mod_base = OTHER; note = uracil
  modified_base 65: mod_base = OTHER; note = uracil
  modified_base 66: mod_base = OTHER; note = uracil
  modified_base 72: mod_base = OTHER; note = uracil
  modified_base 83: mod_base = OTHER; note = uracil
  modified_base 91: mod_base = OTHER; note = uracil
  modified_base 93: mod_base = OTHER; note = uracil
  modified_base 101: mod_base = OTHER; note = uracil
  modified_base 102: mod_base = OTHER; note = uracil
  modified_base 106: mod_base = OTHER; note = uracil
  modified_base 113: mod_base = OTHER; note = uracil
  modified_base 126: mod_base = OTHER; note = uracil
  modified_base 130: mod_base = OTHER; note = uracil
  modified_base 135: mod_base = OTHER; note = uracil
  modified_base 138: mod_base = OTHER; note = uracil
  modified_base 148: mod_base = OTHER; note = uracil
  modified_base 150: mod_base = OTHER; note = uracil
  modified_base 153: mod_base = OTHER; note = uracil
  modified_base 157: mod_base = OTHER; note = uracil
  modified_base 158: mod_base = OTHER; note = uracil
  modified_base 168: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 186: mod_base = OTHER; note = uracil
  modified_base 190: mod_base = OTHER; note = uracil
  modified_base 193: mod_base = OTHER; note = uracil
  modified_base 196: mod_base = OTHER; note = uracil
  modified_base 202: mod_base = OTHER; note = uracil
  modified_base 205: mod_base = OTHER; note = uracil
  modified_base 212: mod_base = OTHER; note = uracil
  modified_base 225: mod_base = OTHER; note = uracil
  modified_base 231: mod_base = OTHER; note = uracil
  modified_base 235: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 259: mod_base = OTHER; note = uracil
  modified_base 267: mod_base = OTHER; note = uracil
  modified_base 268: mod_base = OTHER; note = uracil
  modified_base 276: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 295: mod_base = OTHER; note = uracil
  modified_base 296: mod_base = OTHER; note = uracil
agtaaatagagggtatggtttaatttgtttatgaatygggaagtataatattttaatatttgtgttttaagtagttgttttatttaaaagtataggaaattttgtttttttttttgttataaaattttataaagttattggaaagattttygtaggttagtggtttttaaagtgggtttttagaattagtaatagttgaattattygggaattggttagaaatgtaaagtttygtygttattttttaattttttagatttaatgaattagaaattttggggtgtggtttagtggtttgyg

SEQ ID NO: 458 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 31: mod_base = OTHER; note = uracil
  modified_base 37: mod_base = OTHER; note = uracil
  modified_base 45: mod_base = OTHER; note = uracil
  modified_base 72: mod_base = OTHER; note = uracil
  modified_base 77: mod_base = OTHER; note = uracil
  modified_base 82: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 93: mod_base = OTHER; note = uracil
  modified_base 103: mod_base = OTHER; note = uracil
  modified_base 106: mod_base = OTHER; note = uracil
  modified_base 112: mod_base = OTHER; note = uracil
  modified_base 118: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 145: mod_base = OTHER; note = uracil
  modified_base 146: mod_base = OTHER; note = uracil
  modified_base 156: mod_base = OTHER; note = uracil
  modified_base 160: mod_base = OTHER; note = uracil
  modified_base 161: mod_base = OTHER; note = uracil
  modified_base 167: mod_base = OTHER; note = uracil
  modified_base 185: mod_base = OTHER; note = uracil
  modified_base 197: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 224: mod_base = OTHER; note = uracil
  modified_base 227: mod_base = OTHER; note = uracil
  modified_base 230: mod_base = OTHER; note = uracil
  modified_base 237: mod_base = OTHER; note = uracil
  modified_base 239: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 268: mod_base = OTHER; note = uracil
  modified_base 274: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 299: mod_base = OTHER; note = uracil
ygtaggttattgggttatattttagaatttttggtttattaggtttggggggttgaggggtggyggygagattttgtatttttaattagttttyggatgatttagttgttgttagttttgggaatttattttgaaaattattggtttgyggagatttttttagtagttttgtaagattttataataagaaaaaagataggattttttgtgtttttaagtaaaataattgtttaaggtataaatattaaaatattatgtttttyggtttataggtaagttggattatattttttgtttgtt

SEQ ID NO: 459 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 12: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 22: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 37: mod_base = OTHER; note = uracil
  modified_base 38: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 48: mod_base = OTHER; note = uracil
  modified_base 56: mod_base = OTHER; note = uracil
  modified_base 72: mod_base = OTHER; note = uracil
  modified_base 73: mod_base = OTHER; note = uracil
  modified_base 74: mod_base = OTHER; note = uracil
  modified_base 88: mod_base = OTHER; note = uracil
  modified_base 89: mod_base = OTHER; note = uracil
  modified_base 92: mod_base = OTHER; note = uracil
  modified_base 107: mod_base = OTHER; note = uracil
  modified_base 120: mod_base = OTHER; note = uracil
  modified_base 126: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 139: mod_base = OTHER; note = uracil
  modified_base 147: mod_base = OTHER; note = uracil
  modified_base 150: mod_base = OTHER; note = uracil
  modified_base 156: mod_base = OTHER; note = uracil
  modified_base 158: mod_base = OTHER; note = uracil
  modified_base 176: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 190: mod_base = OTHER; note = uracil
  modified_base 192: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 229: mod_base = OTHER; note = uracil
  modified_base 240: mod_base = OTHER; note = uracil
  modified_base 247: mod_base = OTHER; note = uracil
  modified_base 249: mod_base = OTHER; note = uracil
  modified_base 251: mod_base = OTHER; note = uracil
  modified_base 252: mod_base = OTHER; note = uracil
  modified_base 260: mod_base = OTHER; note = uracil
  modified_base 268: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 300: mod_base = OTHER; note = uracil
gttttatttygtttttttygattttttygggttyggtttgygtttttttgyggtgtygaggagyggtggygttttgggtgaagaagtttygtygagtygaggggygtaatggaggagygtyggaataggttttttatttygagtagttatygttgtattgtgygagtgtaaaagttatttttattyggttttagttgttttaattttagttgaagtgaggaggttggattggaaggtttttggggttattttagtgaggttggggttttagttttaattttatygtggtattttaaaggt

SEQ ID NO: 460 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 13: mod_base = OTHER; note = uracil
  modified_base 14: mod_base = OTHER; note = uracil
  modified_base 30: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 65: mod_base = OTHER; note = uracil
  modified_base 66: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 84: mod_base = OTHER; note = uracil
  modified_base 86: mod_base = OTHER; note = uracil
  modified_base 89: mod_base = OTHER; note = uracil
  modified_base 92: mod_base = OTHER; note = uracil
  modified_base 104: mod_base = OTHER; note = uracil
  modified_base 107: mod_base = OTHER; note = uracil
  modified_base 113: mod_base = OTHER; note = uracil
  modified_base 127: mod_base = OTHER; note = uracil
  modified_base 133: mod_base = OTHER; note = uracil
  modified_base 135: mod_base = OTHER; note = uracil
  modified_base 139: mod_base = OTHER; note = uracil
  modified_base 141: mod_base = OTHER; note = uracil
  modified_base 146: mod_base = OTHER; note = uracil
  modified_base 155: mod_base = OTHER; note = uracil
  modified_base 158: mod_base = OTHER; note = uracil
  modified_base 172: mod_base = OTHER; note = uracil
  modified_base 173: mod_base = OTHER; note = uracil
  modified_base 178: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 205: mod_base = OTHER; note = uracil
  modified_base 215: mod_base = OTHER; note = uracil
  modified_base 218: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 232: mod_base = OTHER; note = uracil
  modified_base 233: mod_base = OTHER; note = uracil
  modified_base 235: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 246: mod_base = OTHER; note = uracil
  modified_base 248: mod_base = OTHER; note = uracil
  modified_base 251: mod_base = OTHER; note = uracil
  modified_base 261: mod_base = OTHER; note = uracil
  modified_base 265: mod_base = OTHER; note = uracil
  modified_base 270: mod_base = OTHER; note = uracil
  modified_base 271: mod_base = OTHER; note = uracil
  modified_base 300: mod_base = OTHER; note = uracil
gtttttggggtgttayggtgagattgggattagaattttagttttattggagtgattttagaaattttttagtttaatttttttattttaattgaggttggaataattgagatygggtggaagtgatttttatattygtatagtgtaayggtagttattyggaatgagagatttgtttyggygtttttttattgygtttttygattyggygggatttttttatttagggygttatygtttttyggtatygtaggaaggygtaggtygggttygggggagtyggggagagyggggtagggt

SEQ ID NO: 461 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 10: mod_base = OTHER; note = uracil
  modified_base 12: mod_base = OTHER; note = uracil
  modified_base 17: mod_base = OTHER; note = uracil
  modified_base 20: mod_base = OTHER; note = uracil
  modified_base 29: mod_base = OTHER; note = uracil
  modified_base 31: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 44: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 70: mod_base = OTHER; note = uracil
  modified_base 73: mod_base = OTHER; note = uracil
  modified_base 85: mod_base = OTHER; note = uracil
  modified_base 86: mod_base = OTHER; note = uracil
  modified_base 88: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 108: mod_base = OTHER; note = uracil
  modified_base 117: mod_base = OTHER; note = uracil
  modified_base 118: mod_base = OTHER; note = uracil
  modified_base 122: mod_base = OTHER; note = uracil
  modified_base 126: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 161: mod_base = OTHER; note = uracil
  modified_base 164: mod_base = OTHER; note = uracil
  modified_base 168: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 187: mod_base = OTHER; note = uracil
  modified_base 189: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 204: mod_base = OTHER; note = uracil
  modified_base 207: mod_base = OTHER; note = uracil
  modified_base 209: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 223: mod_base = OTHER; note = uracil
  modified_base 224: mod_base = OTHER; note = uracil
  modified_base 229: mod_base = OTHER; note = uracil
  modified_base 230: mod_base = OTHER; note = uracil
  modified_base 240: mod_base = OTHER; note = uracil
  modified_base 250: mod_base = OTHER; note = uracil
  modified_base 254: mod_base = OTHER; note = uracil
  modified_base 266: mod_base = OTHER; note = uracil
  modified_base 267: mod_base = OTHER; note = uracil
  modified_base 276: mod_base = OTHER; note = uracil
  modified_base 280: mod_base = OTHER; note = uracil
  modified_base 285: mod_base = OTHER; note = uracil
ggatataatttttgttttttaaagttggtattaagagttttttttgyggttttttttttttttttygagtagtaaaggygtggtttataatgtttattttgtggggtttaggggtgttyggtttgttgatttttaggttttttttgtggygaggtttggattgtatatatggtgtaggttttttattattggagttgttaggatagtattggagattttaagttaatatttatttttggtaataattattaagtatttgtaaaagttygggtatgttggtaaatttttttaaaataagag

SEQ ID NO: 462 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 22: mod_base = OTHER; note = uracil
  modified_base 23: mod_base = OTHER; note = uracil
  modified_base 26: mod_base = OTHER; note = uracil
  modified_base 30: mod_base = OTHER; note = uracil
  modified_base 31: mod_base = OTHER; note = uracil
  modified_base 36: mod_base = OTHER; note = uracil
  modified_base 42: mod_base = OTHER; note = uracil
  modified_base 48: mod_base = OTHER; note = uracil
  modified_base 62: mod_base = OTHER; note = uracil
  modified_base 63: mod_base = OTHER; note = uracil
  modified_base 79: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 95: mod_base = OTHER; note = uracil
  modified_base 99: mod_base = OTHER; note = uracil
  modified_base 100: mod_base = OTHER; note = uracil
  modified_base 104: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 129: mod_base = OTHER; note = uracil
  modified_base 130: mod_base = OTHER; note = uracil
  modified_base 138: mod_base = OTHER; note = uracil
  modified_base 142: mod_base = OTHER; note = uracil
  modified_base 143: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 164: mod_base = OTHER; note = uracil
  modified_base 165: mod_base = OTHER; note = uracil
  modified_base 173: mod_base = OTHER; note = uracil
  modified_base 176: mod_base = OTHER; note = uracil
  modified_base 180: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 200: mod_base = OTHER; note = uracil
  modified_base 209: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 224: mod_base = OTHER; note = uracil
  modified_base 229: mod_base = OTHER; note = uracil
  modified_base 232: mod_base = OTHER; note = uracil
  modified_base 252: mod_base = OTHER; note = uracil
  modified_base 255: mod_base = OTHER; note = uracil
  modified_base 264: mod_base = OTHER; note = uracil
  modified_base 266: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 287: mod_base = OTHER; note = uracil
  modified_base 299: mod_base = OTHER; note = uracil
  modified_base 300: mod_base = OTHER; note = uracil
tttttattttaaaaagatttgttagtatattygggtttttataaatgtttgataattattgttaaaaataggtattggtttagggtttttagtgttgttttggtagttttagtgatgaggggtttgtattatgtatgtagtttaaatttygttatagagggggtttggaggttagtaagtygggtatttttagattttatagggtgggtattgtggattaygtttttgttgttygaggagaggaaggggaatygtaggaggagtttttagtgttaattttgaagaatagagattgtgttt

SEQ ID NO: 463 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 10: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 45: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 70: mod_base = OTHER; note = uracil
  modified_base 76: mod_base = OTHER; note = uracil
  modified_base 77: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 92: mod_base = OTHER; note = uracil
  modified_base 108: mod_base = OTHER; note = uracil
  modified_base 110: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 139: mod_base = OTHER; note = uracil
  modified_base 146: mod_base = OTHER; note = uracil
  modified_base 147: mod_base = OTHER; note = uracil
  modified_base 154: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 195: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 218: mod_base = OTHER; note = uracil
  modified_base 227: mod_base = OTHER; note = uracil
  modified_base 229: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 258: mod_base = OTHER; note = uracil
  modified_base 268: mod_base = OTHER; note = uracil
  modified_base 274: mod_base = OTHER; note = uracil
  modified_base 275: mod_base = OTHER; note = uracil
  modified_base 281: mod_base = OTHER; note = uracil
atttgagygtttttttattttagtaggttygttgttattaagggtttattttgtgggttgtttaygttgttgtaattagtgattataagtttygtggtgttgagaagtatatgtttttttttttayggttgtgtaggttyggagttttaygggtttagttagtttttttgttttaggtttaattaggtyggaattaagatgttagggtttggttgtgttttggaggtttttggtgagaatttgtttttggtttggtgtagggtgtggtagaatttygatgtttgagtttgaatggtgaaa

SEQ ID NO: 464 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 7: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 58: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 103: mod_base = OTHER; note = uracil
  modified_base 110: mod_base = OTHER; note = uracil
  modified_base 114: mod_base = OTHER; note = uracil
  modified_base 115: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 139: mod_base = OTHER; note = uracil
  modified_base 143: mod_base = OTHER; note = uracil
  modified_base 148: mod_base = OTHER; note = uracil
  modified_base 149: mod_base = OTHER; note = uracil
  modified_base 157: mod_base = OTHER; note = uracil
  modified_base 159: mod_base = OTHER; note = uracil
  modified_base 164: mod_base = OTHER; note = uracil
  modified_base 165: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 188: mod_base = OTHER; note = uracil
  modified_base 194: mod_base = OTHER; note = uracil
  modified_base 197: mod_base = OTHER; note = uracil
  modified_base 199: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 220: mod_base = OTHER; note = uracil
  modified_base 222: mod_base = OTHER; note = uracil
  modified_base 229: mod_base = OTHER; note = uracil
  modified_base 232: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 267: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 294: mod_base = OTHER; note = uracil
  modified_base 296: mod_base = OTHER; note = uracil
ttttattatttaaatttaagtatygggattttgttatattttgtattaggttagaagtaggtttttattaagagtttttaaagtatagttaggttttggtattttgatttyggtttggttaaatttggagtagggggattggttgagttygtaggatttyggatttatatagtygtgggaggagaaatatgtgttttttaatattayggagtttgtggttattggttatagtagygtgggtagtttatagggtaagtttttgatggtagygggtttgttggggtggagaagygtttaagt

SEQ ID NO: 465 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 10: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 28: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 44: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 55: mod_base = OTHER; note = uracil
  modified_base 59: mod_base = OTHER; note = uracil
  modified_base 62: mod_base = OTHER; note = uracil
  modified_base 66: mod_base = OTHER; note = uracil
  modified_base 67: mod_base = OTHER; note = uracil
  modified_base 79: mod_base = OTHER; note = uracil
  modified_base 89: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 108: mod_base = OTHER; note = uracil
  modified_base 110: mod_base = OTHER; note = uracil
  modified_base 122: mod_base = OTHER; note = uracil
  modified_base 123: mod_base = OTHER; note = uracil
  modified_base 132: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 146: mod_base = OTHER; note = uracil
  modified_base 151: mod_base = OTHER; note = uracil
  modified_base 160: mod_base = OTHER; note = uracil
  modified_base 171: mod_base = OTHER; note = uracil
  modified_base 174: mod_base = OTHER; note = uracil
  modified_base 178: mod_base = OTHER; note = uracil
  modified_base 189: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 208: mod_base = OTHER; note = uracil
  modified_base 211: mod_base = OTHER; note = uracil
  modified_base 219: mod_base = OTHER; note = uracil
  modified_base 225: mod_base = OTHER; note = uracil
  modified_base 227: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 256: mod_base = OTHER; note = uracil
  modified_base 257: mod_base = OTHER; note = uracil
  modified_base 265: mod_base = OTHER; note = uracil
  modified_base 272: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 297: mod_base = OTHER; note = uracil
  modified_base 299: mod_base = OTHER; note = uracil
aaatttaygttggtttaagaggaggaatagagaagttttttggttgaggtttagtygattgttgattyggaaaagtttttygaggtgatttatatttttagtttttgtatatgtgggtgagttagttgtagttttgttttygtgattgagtaygggaygtyggaggtatttattaggtatgaggttatttgtttattttttatgtgttagtygagtgatygaattttagttttttagtttttatatttttagggttttagtggattgtaagttggtgataagagttgtgttgtttttatt

SEQ ID NO: 466 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 11: mod_base = OTHER; note = uracil
  modified_base 13: mod_base = OTHER; note = uracil
  modified_base 16: mod_base = OTHER; note = uracil
  modified_base 18: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 29: mod_base = OTHER; note = uracil
  modified_base 33: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 46: mod_base = OTHER; note = uracil
  modified_base 47: mod_base = OTHER; note = uracil
  modified_base 48: mod_base = OTHER; note = uracil
  modified_base 63: mod_base = OTHER; note = uracil
  modified_base 71: mod_base = OTHER; note = uracil
  modified_base 83: mod_base = OTHER; note = uracil
  modified_base 85: mod_base = OTHER; note = uracil
  modified_base 90: mod_base = OTHER; note = uracil
  modified_base 94: mod_base = OTHER; note = uracil
  modified_base 96: mod_base = OTHER; note = uracil
  modified_base 109: mod_base = OTHER; note = uracil
  modified_base 116: mod_base = OTHER; note = uracil
  modified_base 117: mod_base = OTHER; note = uracil
  modified_base 119: mod_base = OTHER; note = uracil
  modified_base 123: mod_base = OTHER; note = uracil
  modified_base 124: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 144: mod_base = OTHER; note = uracil
  modified_base 145: mod_base = OTHER; note = uracil
  modified_base 150: mod_base = OTHER; note = uracil
  modified_base 152: mod_base = OTHER; note = uracil
  modified_base 156: mod_base = OTHER; note = uracil
  modified_base 164: mod_base = OTHER; note = uracil
  modified_base 169: mod_base = OTHER; note = uracil
  modified_base 172: mod_base = OTHER; note = uracil
  modified_base 175: mod_base = OTHER; note = uracil
  modified_base 179: mod_base = OTHER; note = uracil
  modified_base 181: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 193: mod_base = OTHER; note = uracil
  modified_base 199: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 225: mod_base = OTHER; note = uracil
  modified_base 230: mod_base = OTHER; note = uracil
  modified_base 236: mod_base = OTHER; note = uracil
  modified_base 239: mod_base = OTHER; note = uracil
  modified_base 246: mod_base = OTHER; note = uracil
  modified_base 251: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 258: mod_base = OTHER; note = uracil
  modified_base 265: mod_base = OTHER; note = uracil
  modified_base 268: mod_base = OTHER; note = uracil
  modified_base 270: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 287: mod_base = OTHER; note = uracil
  modified_base 288: mod_base = OTHER; note = uracil
gtgagggtagtataatttttattattagtttatagtttattaggattttagggatgtaggggttaagggattgagattyggttattyggttgatatatgggaagtaggtagataattttatgtttgatgaatattttyggygtttygtgtttagttaygggaatagagttataattggtttatttatatgtgtagaggttggggatgtgagttatttygagaaattttttygggttagtagtyggttgggttttagttaggaagtttttttgtttttttttttgggttagygtgagtttt

SEQ ID NO: 467 - DNA, 300 bp, synthetic construct; identical to SEQ ID NO: 463
  misc_feature 1..300: note = Synthetic polynucleotide
  source 1..300: mol_type = other DNA
  modified_base 2: mod_base = OTHER; note = uracil
  modified_base 10: mod_base = OTHER; note = uracil
  modified_base 13: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 28: mod_base = OTHER; note = uracil
  modified_base 29: mod_base = OTHER; note = uracil
  modified_base 32: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 45: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 70: mod_base = OTHER; note = uracil
  modified_base 76: mod_base = OTHER; note = uracil
  modified_base 77: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 92: mod_base = OTHER; note = uracil
  modified_base 108: mod_base = OTHER; note = uracil
  modified_base 110: mod_base = OTHER; note = uracil
  modified_base 117: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 139: mod_base = OTHER; note = uracil
  modified_base 146: mod_base = OTHER; note = uracil
  modified_base 147: mod_base = OTHER; note = uracil
  modified_base 154: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 173: mod_base = OTHER; note = uracil
  modified_base 174: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 195: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 218: mod_base = OTHER; note = uracil
  modified_base 227: mod_base = OTHER; note = uracil
  modified_base 229: mod_base = OTHER; note = uracil
  modified_base 240: mod_base = OTHER; note = uracil
  modified_base 241: mod_base = OTHER; note = uracil
  modified_base 244: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 258: mod_base = OTHER; note = uracil
  modified_base 268: mod_base = OTHER; note = uracil
  modified_base 274: mod_base = OTHER; note = uracil
  modified_base 275: mod_base = OTHER; note = uracil
  modified_base 281: mod_base = OTHER; note = uracil

SEQ ID NO: 468 - DNA, 300 bp, synthetic construct; identical to SEQ ID NO: 464
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 7: mod_base = OTHER; note = uracil
  modified_base 11: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 58: mod_base = OTHER; note = uracil
  modified_base 64: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 75: mod_base = OTHER; note = uracil
  modified_base 76: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 86: mod_base = OTHER; note = uracil
  modified_base 89: mod_base = OTHER; note = uracil
  modified_base 90: mod_base = OTHER; note = uracil
  modified_base 94: mod_base = OTHER; note = uracil
  modified_base 95: mod_base = OTHER; note = uracil
  modified_base 96: mod_base = OTHER; note = uracil
  modified_base 100: mod_base = OTHER; note = uracil
  modified_base 103: mod_base = OTHER; note = uracil
  modified_base 110: mod_base = OTHER; note = uracil
  modified_base 114: mod_base = OTHER; note = uracil
  modified_base 115: mod_base = OTHER; note = uracil
  modified_base 124: mod_base = OTHER; note = uracil
  modified_base 125: mod_base = OTHER; note = uracil
  modified_base 131: mod_base = OTHER; note = uracil
  modified_base 139: mod_base = OTHER; note = uracil
  modified_base 143: mod_base = OTHER; note = uracil
  modified_base 148: mod_base = OTHER; note = uracil
  modified_base 149: mod_base = OTHER; note = uracil
  modified_base 157: mod_base = OTHER; note = uracil
  modified_base 159: mod_base = OTHER; note = uracil
  modified_base 164: mod_base = OTHER; note = uracil
  modified_base 165: mod_base = OTHER; note = uracil
  modified_base 168: mod_base = OTHER; note = uracil
  modified_base 170: mod_base = OTHER; note = uracil
  modified_base 173: mod_base = OTHER; note = uracil
  modified_base 188: mod_base = OTHER; note = uracil
  modified_base 194: mod_base = OTHER; note = uracil
  modified_base 197: mod_base = OTHER; note = uracil
  modified_base 199: mod_base = OTHER; note = uracil
  modified_base 202: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 220: mod_base = OTHER; note = uracil
  modified_base 222: mod_base = OTHER; note = uracil
  modified_base 229: mod_base = OTHER; note = uracil
  modified_base 232: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 267: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 294: mod_base = OTHER; note = uracil
  modified_base 296: mod_base = OTHER; note = uracil

SEQ ID NO: 469 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 14: mod_base = OTHER; note = uracil
  modified_base 25: mod_base = OTHER; note = uracil
  modified_base 30: mod_base = OTHER; note = uracil
  modified_base 43: mod_base = OTHER; note = uracil
  modified_base 47: mod_base = OTHER; note = uracil
  modified_base 57: mod_base = OTHER; note = uracil
  modified_base 72: mod_base = OTHER; note = uracil
  modified_base 81: mod_base = OTHER; note = uracil
  modified_base 85: mod_base = OTHER; note = uracil
  modified_base 99: mod_base = OTHER; note = uracil
  modified_base 132: mod_base = OTHER; note = uracil
  modified_base 133: mod_base = OTHER; note = uracil
  modified_base 137: mod_base = OTHER; note = uracil
  modified_base 164: mod_base = OTHER; note = uracil
  modified_base 177: mod_base = OTHER; note = uracil
  modified_base 183: mod_base = OTHER; note = uracil
  modified_base 185: mod_base = OTHER; note = uracil
  modified_base 191: mod_base = OTHER; note = uracil
  modified_base 196: mod_base = OTHER; note = uracil
  modified_base 198: mod_base = OTHER; note = uracil
  modified_base 203: mod_base = OTHER; note = uracil
  modified_base 247: mod_base = OTHER; note = uracil
  modified_base 253: mod_base = OTHER; note = uracil
  modified_base 263: mod_base = OTHER; note = uracil
  modified_base 266: mod_base = OTHER; note = uracil
  modified_base 278: mod_base = OTHER; note = uracil
  modified_base 291: mod_base = OTHER; note = uracil
gygaataaaaagttagtgtgtgagtaagtttgtgggaagatgtatgtagagtgtgatagagagtttaggggttygtgtgataattygtggaaatgtttttaaaggygagggtatgtgtgtgggtgtgaggattyggttgttggatgtttaygtattttattagttagataygggagttaatatttaattgtagtgtattaaatattattaggtgggtatgattttgagggaatgagggaagggagataaggtttggtgagattatttgtgggattatttgtgtgtatttgttggtttgta

SEQ ID NO: 470 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 11: mod_base = OTHER; note = uracil
  modified_base 17: mod_base = OTHER; note = uracil
  modified_base 19: mod_base = OTHER; note = uracil
  modified_base 21: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 41: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 81: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 106: mod_base = OTHER; note = uracil
  modified_base 108: mod_base = OTHER; note = uracil
  modified_base 111: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 134: mod_base = OTHER; note = uracil
  modified_base 138: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 165: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 184: mod_base = OTHER; note = uracil
  modified_base 186: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 197: mod_base = OTHER; note = uracil
  modified_base 206: mod_base = OTHER; note = uracil
  modified_base 211: mod_base = OTHER; note = uracil
  modified_base 212: mod_base = OTHER; note = uracil
  modified_base 222: mod_base = OTHER; note = uracil
  modified_base 224: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 238: mod_base = OTHER; note = uracil
  modified_base 240: mod_base = OTHER; note = uracil
  modified_base 242: mod_base = OTHER; note = uracil
  modified_base 246: mod_base = OTHER; note = uracil
  modified_base 248: mod_base = OTHER; note = uracil
  modified_base 250: mod_base = OTHER; note = uracil
  modified_base 252: mod_base = OTHER; note = uracil
  modified_base 255: mod_base = OTHER; note = uracil
  modified_base 259: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 273: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 283: mod_base = OTHER; note = uracil
  modified_base 285: mod_base = OTHER; note = uracil
  modified_base 289: mod_base = OTHER; note = uracil
  modified_base 300: mod_base = OTHER; note = uracil
tataaattagtaaatatatatagataattttatagatgattttattagattttgtttttttttttttatttttttaaaattatatttatttaataatgtttagtgtattgtaattgagtattagttttygtatttagttaataaaataygtaaatatttaatagtygggtttttatatttatatatatattttygtttttagaaatatttttayggattgttataygagtttttaaattttttgttatattttgtatgtatttttttatagatttgtttatatattggttttttattygt

SEQ ID NO: 471 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 15: mod_base = OTHER; note = uracil
  modified_base 19: mod_base = OTHER; note = uracil
  modified_base 20: mod_base = OTHER; note = uracil
  modified_base 22: mod_base = OTHER; note = uracil
  modified_base 25: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 52: mod_base = OTHER; note = uracil
  modified_base 54: mod_base = OTHER; note = uracil
  modified_base 58: mod_base = OTHER; note = uracil
  modified_base 60: mod_base = OTHER; note = uracil
  modified_base 79: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 102: mod_base = OTHER; note = uracil
  modified_base 109: mod_base = OTHER; note = uracil
  modified_base 123: mod_base = OTHER; note = uracil
  modified_base 125: mod_base = OTHER; note = uracil
  modified_base 130: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 147: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 194: mod_base = OTHER; note = uracil
  modified_base 202: mod_base = OTHER; note = uracil
  modified_base 204: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 226: mod_base = OTHER; note = uracil
  modified_base 236: mod_base = OTHER; note = uracil
  modified_base 240: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 270: mod_base = OTHER; note = uracil
  modified_base 271: mod_base = OTHER; note = uracil
  modified_base 274: mod_base = OTHER; note = uracil
  modified_base 277: mod_base = OTHER; note = uracil
  modified_base 279: mod_base = OTHER; note = uracil
  modified_base 283: mod_base = OTHER; note = uracil
  modified_base 288: mod_base = OTHER; note = uracil
  modified_base 291: mod_base = OTHER; note = uracil
  modified_base 295: mod_base = OTHER; note = uracil
tagtgagttgagagtaygttattgtattttagtttgggggatagagtgagattttgttttaaaaaaagaaaaaaagaattgattttaaatgtgtggggagattgattttagtaataataaaatttyggttttttatatagttagttttgygtgaatttttttttttttattgygatttttttgatttgagtgatagtaaaatttyggttttttgtatagttagttttgygtgagttatttttttttttttgtaatttttttgttttgatttattagttttgtttgggtagtaggtaaggt

SEQ ID NO: 472 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 7: mod_base = OTHER; note = uracil
  modified_base 8: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 20: mod_base = OTHER; note = uracil
  modified_base 25: mod_base = OTHER; note = uracil
  modified_base 34: mod_base = OTHER; note = uracil
  modified_base 39: mod_base = OTHER; note = uracil
  modified_base 50: mod_base = OTHER; note = uracil
  modified_base 67: mod_base = OTHER; note = uracil
  modified_base 69: mod_base = OTHER; note = uracil
  modified_base 73: mod_base = OTHER; note = uracil
  modified_base 78: mod_base = OTHER; note = uracil
  modified_base 82: mod_base = OTHER; note = uracil
  modified_base 87: mod_base = OTHER; note = uracil
  modified_base 94: mod_base = OTHER; note = uracil
  modified_base 105: mod_base = OTHER; note = uracil
  modified_base 109: mod_base = OTHER; note = uracil
  modified_base 111: mod_base = OTHER; note = uracil
  modified_base 113: mod_base = OTHER; note = uracil
  modified_base 118: mod_base = OTHER; note = uracil
  modified_base 129: mod_base = OTHER; note = uracil
  modified_base 148: mod_base = OTHER; note = uracil
  modified_base 152: mod_base = OTHER; note = uracil
  modified_base 157: mod_base = OTHER; note = uracil
  modified_base 161: mod_base = OTHER; note = uracil
  modified_base 173: mod_base = OTHER; note = uracil
  modified_base 190: mod_base = OTHER; note = uracil
  modified_base 197: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 210: mod_base = OTHER; note = uracil
  modified_base 220: mod_base = OTHER; note = uracil
  modified_base 225: mod_base = OTHER; note = uracil
  modified_base 233: mod_base = OTHER; note = uracil
  modified_base 245: mod_base = OTHER; note = uracil
  modified_base 251: mod_base = OTHER; note = uracil
  modified_base 253: mod_base = OTHER; note = uracil
  modified_base 255: mod_base = OTHER; note = uracil
  modified_base 257: mod_base = OTHER; note = uracil
  modified_base 261: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 269: mod_base = OTHER; note = uracil
  modified_base 277: mod_base = OTHER; note = uracil
  modified_base 287: mod_base = OTHER; note = uracil
  modified_base 289: mod_base = OTHER; note = uracil
  modified_base 291: mod_base = OTHER; note = uracil
  modified_base 294: mod_base = OTHER; note = uracil
  modified_base 296: mod_base = OTHER; note = uracil
  modified_base 298: mod_base = OTHER; note = uracil
attttgtttgttgtttagatagagttgatggattaagataggggaattataggggagaaagaatgatttaygtagagttggttgtgtaggagatyggagttttattgttatttaaattaggggaatygtaatagggaaagagggatttaygtagagttggttgtgtgggagatyggagttttattattattgaaattagtttttttatatatttgggattagttttttttttttttttttgagatagagttttattttattttttaggttggagtgtagtggygtgtttttagtttattg

SEQ ID NO: 473 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 15: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 34: mod_base = OTHER; note = uracil
  modified_base 37: mod_base = OTHER; note = uracil
  modified_base 43: mod_base = OTHER; note = uracil
  modified_base 49: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 69: mod_base = OTHER; note = uracil
  modified_base 77: mod_base = OTHER; note = uracil
  modified_base 78: mod_base = OTHER; note = uracil
  modified_base 86: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 98: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 108: mod_base = OTHER; note = uracil
  modified_base 112: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 128: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 159: mod_base = OTHER; note = uracil
  modified_base 161: mod_base = OTHER; note = uracil
  modified_base 163: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 190: mod_base = OTHER; note = uracil
  modified_base 193: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 206: mod_base = OTHER; note = uracil
  modified_base 208: mod_base = OTHER; note = uracil
  modified_base 213: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 253: mod_base = OTHER; note = uracil
  modified_base 258: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 277: mod_base = OTHER; note = uracil
  modified_base 278: mod_base = OTHER; note = uracil
  modified_base 286: mod_base = OTHER; note = uracil
  modified_base 288: mod_base = OTHER; note = uracil
  modified_base 297: mod_base = OTHER; note = uracil
  modified_base 299: mod_base = OTHER; note = uracil
  modified_base 300: mod_base = OTHER; note = uracil
ggatgtyggtgtgttaattttagttttattttattgttaaagtttaagtttttttttttttygttaagttgtatgattttgagttttttgtgttttattgtttttatttgttaagtgaaaatgtttttagtttttattttygggagttgygtgggaggtatatatgaatattaggaaagtgagtttatgtagttygggttagggatttyggtttttgtttttgttttaatttttayggtttgggggaaygtgtagggttgaggaagygtagtttttttttggaattttagyggaagtttt

SEQ ID NO: 474 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 8: mod_base = OTHER; note = uracil
  modified_base 11: mod_base = OTHER; note = uracil
  modified_base 19: mod_base = OTHER; note = uracil
  modified_base 20: mod_base = OTHER; note = uracil
  modified_base 30: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 63: mod_base = OTHER; note = uracil
  modified_base 78: mod_base = OTHER; note = uracil
  modified_base 84: mod_base = OTHER; note = uracil
  modified_base 90: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 103: mod_base = OTHER; note = uracil
  modified_base 104: mod_base = OTHER; note = uracil
  modified_base 109: mod_base = OTHER; note = uracil
  modified_base 112: mod_base = OTHER; note = uracil
  modified_base 118: mod_base = OTHER; note = uracil
  modified_base 120: mod_base = OTHER; note = uracil
  modified_base 122: mod_base = OTHER; note = uracil
  modified_base 126: mod_base = OTHER; note = uracil
  modified_base 127: mod_base = OTHER; note = uracil
  modified_base 135: mod_base = OTHER; note = uracil
  modified_base 143: mod_base = OTHER; note = uracil
  modified_base 144: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 152: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 171: mod_base = OTHER; note = uracil
  modified_base 178: mod_base = OTHER; note = uracil
  modified_base 184: mod_base = OTHER; note = uracil
  modified_base 186: mod_base = OTHER; note = uracil
  modified_base 191: mod_base = OTHER; note = uracil
  modified_base 201: mod_base = OTHER; note = uracil
  modified_base 209: mod_base = OTHER; note = uracil
  modified_base 211: mod_base = OTHER; note = uracil
  modified_base 218: mod_base = OTHER; note = uracil
  modified_base 220: mod_base = OTHER; note = uracil
  modified_base 226: mod_base = OTHER; note = uracil
  modified_base 230: mod_base = OTHER; note = uracil
  modified_base 233: mod_base = OTHER; note = uracil
  modified_base 253: mod_base = OTHER; note = uracil
  modified_base 259: mod_base = OTHER; note = uracil
  modified_base 265: mod_base = OTHER; note = uracil
  modified_base 278: mod_base = OTHER; note = uracil
  modified_base 288: mod_base = OTHER; note = uracil
  modified_base 290: mod_base = OTHER; note = uracil
  modified_base 292: mod_base = OTHER; note = uracil
  modified_base 296: mod_base = OTHER; note = uracil
  modified_base 299: mod_base = OTHER; note = uracil
  modified_base 300: mod_base = OTHER; note = uracil
ggagttttygttgagattttaaggagaggttgygtttttttagttttgtaygtttttttaggtygtggggattagggtagaggtagagatyggagtttttggttygggttgtataaatttatttttttggtgtttatgtgtgttttttaygtaattttyggaggtggggattgggagtatttttatttgatagatgaggatagtgaggtataaagaatttaaggttatatagtttaaygggggaggggagagtttaagttttagtagtggggtggagttggggttggtatatygatattt

SEQ ID NO: 475 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 12: mod_base = OTHER; note = uracil
  modified_base 19: mod_base = OTHER; note = uracil
  modified_base 24: mod_base = OTHER; note = uracil
  modified_base 25: mod_base = OTHER; note = uracil
  modified_base 31: mod_base = OTHER; note = uracil
  modified_base 38: mod_base = OTHER; note = uracil
  modified_base 39: mod_base = OTHER; note = uracil
  modified_base 43: mod_base = OTHER; note = uracil
  modified_base 49: mod_base = OTHER; note = uracil
  modified_base 51: mod_base = OTHER; note = uracil
  modified_base 60: mod_base = OTHER; note = uracil
  modified_base 61: mod_base = OTHER; note = uracil
  modified_base 68: mod_base = OTHER; note = uracil
  modified_base 77: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 99: mod_base = OTHER; note = uracil
  modified_base 104: mod_base = OTHER; note = uracil
  modified_base 110: mod_base = OTHER; note = uracil
  modified_base 113: mod_base = OTHER; note = uracil
  modified_base 114: mod_base = OTHER; note = uracil
  modified_base 121: mod_base = OTHER; note = uracil
  modified_base 122: mod_base = OTHER; note = uracil
  modified_base 138: mod_base = OTHER; note = uracil
  modified_base 146: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 171: mod_base = OTHER; note = uracil
  modified_base 174: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 188: mod_base = OTHER; note = uracil
  modified_base 193: mod_base = OTHER; note = uracil
  modified_base 203: mod_base = OTHER; note = uracil
  modified_base 205: mod_base = OTHER; note = uracil
  modified_base 209: mod_base = OTHER; note = uracil
  modified_base 214: mod_base = OTHER; note = uracil
  modified_base 218: mod_base = OTHER; note = uracil
  modified_base 223: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 240: mod_base = OTHER; note = uracil
  modified_base 243: mod_base = OTHER; note = uracil
  modified_base 245: mod_base = OTHER; note = uracil
  modified_base 273: mod_base = OTHER; note = uracil
  modified_base 281: mod_base = OTHER; note = uracil
  modified_base 284: mod_base = OTHER; note = uracil
taattgaattatataatttatttttattatttgagttttyggtttaggttttttgagtattaygaattaggaatgattatgttttattttatttttygttagttaaagattgttaggaggttyggggttgtggtatttaaygttatagaygtaaggtttttttgtttatttagtattttaaatattttatgatatatgaaggttttgatattgtaaatyggattaygataagtttttgattttttygggttgtgaggagttttagaaaataattgagaagtaatttttttgaggatgatg

SEQ ID NO: 476 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 21: mod_base = OTHER; note = uracil
  modified_base 24: mod_base = OTHER; note = uracil
  modified_base 26: mod_base = OTHER; note = uracil
  modified_base 36: mod_base = OTHER; note = uracil
  modified_base 42: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 49: mod_base = OTHER; note = uracil
  modified_base 52: mod_base = OTHER; note = uracil
  modified_base 53: mod_base = OTHER; note = uracil
  modified_base 63: mod_base = OTHER; note = uracil
  modified_base 69: mod_base = OTHER; note = uracil
  modified_base 80: mod_base = OTHER; note = uracil
  modified_base 88: mod_base = OTHER; note = uracil
  modified_base 94: mod_base = OTHER; note = uracil
  modified_base 99: mod_base = OTHER; note = uracil
  modified_base 100: mod_base = OTHER; note = uracil
  modified_base 103: mod_base = OTHER; note = uracil
  modified_base 110: mod_base = OTHER; note = uracil
  modified_base 128: mod_base = OTHER; note = uracil
  modified_base 137: mod_base = OTHER; note = uracil
  modified_base 145: mod_base = OTHER; note = uracil
  modified_base 146: mod_base = OTHER; note = uracil
  modified_base 153: mod_base = OTHER; note = uracil
  modified_base 168: mod_base = OTHER; note = uracil
  modified_base 169: mod_base = OTHER; note = uracil
  modified_base 171: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 189: mod_base = OTHER; note = uracil
  modified_base 193: mod_base = OTHER; note = uracil
  modified_base 199: mod_base = OTHER; note = uracil
  modified_base 220: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 244: mod_base = OTHER; note = uracil
  modified_base 246: mod_base = OTHER; note = uracil
  modified_base 253: mod_base = OTHER; note = uracil
  modified_base 254: mod_base = OTHER; note = uracil
  modified_base 259: mod_base = OTHER; note = uracil
  modified_base 266: mod_base = OTHER; note = uracil
  modified_base 268: mod_base = OTHER; note = uracil
  modified_base 295: mod_base = OTHER; note = uracil
tattatttttaaaaaagttgttttttagttattttttaaaattttttataattyggagaagttaaaggtttgtygtagttyggtttgtaatgttagagtttttatatgttatgaaatatttggagtgttgggtgggtaggagggttttaygtttgtaaygttgaatattataatttygggttttttggtagtttttgattagygaagggtgaagtggagtatagttatttttgattygtggtatttaaagagtttaagtygggaatttagataatggaaatgaattatgtgatttaatta

SEQ ID NO: 477 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 8: mod_base = OTHER; note = uracil
  modified_base 9: mod_base = OTHER; note = uracil
  modified_base 16: mod_base = OTHER; note = uracil
  modified_base 17: mod_base = OTHER; note = uracil
  modified_base 20: mod_base = OTHER; note = uracil
  modified_base 23: mod_base = OTHER; note = uracil
  modified_base 24: mod_base = OTHER; note = uracil
  modified_base 29: mod_base = OTHER; note = uracil
  modified_base 30: mod_base = OTHER; note = uracil
  modified_base 35: mod_base = OTHER; note = uracil
  modified_base 39: mod_base = OTHER; note = uracil
  modified_base 48: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 66: mod_base = OTHER; note = uracil
  modified_base 67: mod_base = OTHER; note = uracil
  modified_base 73: mod_base = OTHER; note = uracil
  modified_base 74: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 88: mod_base = OTHER; note = uracil
  modified_base 93: mod_base = OTHER; note = uracil
  modified_base 99: mod_base = OTHER; note = uracil
  modified_base 114: mod_base = OTHER; note = uracil
  modified_base 117: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 128: mod_base = OTHER; note = uracil
  modified_base 136: mod_base = OTHER; note = uracil
  modified_base 138: mod_base = OTHER; note = uracil
  modified_base 145: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 166: mod_base = OTHER; note = uracil
  modified_base 174: mod_base = OTHER; note = uracil
  modified_base 177: mod_base = OTHER; note = uracil
  modified_base 181: mod_base = OTHER; note = uracil
  modified_base 185: mod_base = OTHER; note = uracil
  modified_base 186: mod_base = OTHER; note = uracil
  modified_base 194: mod_base = OTHER; note = uracil
  modified_base 198: mod_base = OTHER; note = uracil
  modified_base 199: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 212: mod_base = OTHER; note = uracil
  modified_base 221: mod_base = OTHER; note = uracil
  modified_base 226: mod_base = OTHER; note = uracil
  modified_base 232: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 254: mod_base = OTHER; note = uracil
  modified_base 256: mod_base = OTHER; note = uracil
  modified_base 261: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 292: mod_base = OTHER; note = uracil
  modified_base 296: mod_base = OTHER; note = uracil
  modified_base 297: mod_base = OTHER; note = uracil
  modified_base 299: mod_base = OTHER; note = uracil
  modified_base 300: mod_base = OTHER; note = uracil
taatattttttgtatttagtattttttgttatgttattttatagatgtttttattaaagtgatggttaatttttttatttttygaattygggttttggtaaatgggatgttaataatagtttttaaatagaggattatatagtatttgygtgagtttattttttttttatgttttttaagtatgttatgagaataygtttgggttagtttgttgaaggagttgagttgagttatttyggtgatagttagttgatttttagtagtgagaggtatttttataaagttgttttgttgattatt

SEQ ID NO: 478 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 14: mod_base = OTHER; note = uracil
  modified_base 17: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 35: mod_base = OTHER; note = uracil
  modified_base 37: mod_base = OTHER; note = uracil
  modified_base 40: mod_base = OTHER; note = uracil
  modified_base 48: mod_base = OTHER; note = uracil
  modified_base 51: mod_base = OTHER; note = uracil
  modified_base 55: mod_base = OTHER; note = uracil
  modified_base 59: mod_base = OTHER; note = uracil
  modified_base 61: mod_base = OTHER; note = uracil
  modified_base 70: mod_base = OTHER; note = uracil
  modified_base 72: mod_base = OTHER; note = uracil
  modified_base 75: mod_base = OTHER; note = uracil
  modified_base 77: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 86: mod_base = OTHER; note = uracil
  modified_base 89: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 99: mod_base = OTHER; note = uracil
  modified_base 109: mod_base = OTHER; note = uracil
  modified_base 111: mod_base = OTHER; note = uracil
  modified_base 116: mod_base = OTHER; note = uracil
  modified_base 120: mod_base = OTHER; note = uracil
  modified_base 129: mod_base = OTHER; note = uracil
  modified_base 146: mod_base = OTHER; note = uracil
  modified_base 148: mod_base = OTHER; note = uracil
  modified_base 152: mod_base = OTHER; note = uracil
  modified_base 158: mod_base = OTHER; note = uracil
  modified_base 167: mod_base = OTHER; note = uracil
  modified_base 168: mod_base = OTHER; note = uracil
  modified_base 170: mod_base = OTHER; note = uracil
  modified_base 181: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 241: mod_base = OTHER; note = uracil
  modified_base 253: mod_base = OTHER; note = uracil
  modified_base 256: mod_base = OTHER; note = uracil
  modified_base 267: mod_base = OTHER; note = uracil
  modified_base 272: mod_base = OTHER; note = uracil
  modified_base 281: mod_base = OTHER; note = uracil
  modified_base 288: mod_base = OTHER; note = uracil
  modified_base 300: mod_base = OTHER; note = uracil
gtggttagtagagtagttttgtgggggtgttttttattgttaagagttagttggttgttatygggatgatttagtttagtttttttagtaggttgatttaggygtgtttttatggtatgtttgaagaatataagaggggagtgggtttaygtaagtattatgtgattttttgtttgggagttgttgttaatattttatttgttaaagttyggattygaagggtaaggaaattggttattattttagtgagagtatttatagaatgatatggtaaaggatgttggatataaggaatgttgt

SEQ ID NO: 479 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 6: mod_base = OTHER; note = uracil
  modified_base 8: mod_base = OTHER; note = uracil
  modified_base 20: mod_base = OTHER; note = uracil
  modified_base 21: mod_base = OTHER; note = uracil
  modified_base 27: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 42: mod_base = OTHER; note = uracil
  modified_base 47: mod_base = OTHER; note = uracil
  modified_base 53: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 82: mod_base = OTHER; note = uracil
  modified_base 90: mod_base = OTHER; note = uracil
  modified_base 92: mod_base = OTHER; note = uracil
  modified_base 99: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 128: mod_base = OTHER; note = uracil
  modified_base 131: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 159: mod_base = OTHER; note = uracil
  modified_base 162: mod_base = OTHER; note = uracil
  modified_base 163: mod_base = OTHER; note = uracil
  modified_base 166: mod_base = OTHER; note = uracil
  modified_base 175: mod_base = OTHER; note = uracil
  modified_base 180: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 197: mod_base = OTHER; note = uracil
  modified_base 200: mod_base = OTHER; note = uracil
  modified_base 201: mod_base = OTHER; note = uracil
  modified_base 204: mod_base = OTHER; note = uracil
  modified_base 208: mod_base = OTHER; note = uracil
  modified_base 210: mod_base = OTHER; note = uracil
  modified_base 215: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 233: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 262: mod_base = OTHER; note = uracil
  modified_base 268: mod_base = OTHER; note = uracil
  modified_base 283: mod_base = OTHER; note = uracil
  modified_base 284: mod_base = OTHER; note = uracil
  modified_base 289: mod_base = OTHER; note = uracil
  modified_base 294: mod_base = OTHER; note = uracil
  modified_base 296: mod_base = OTHER; note = uracil
gtttttattaaagtgatggttaatttttttatttttygaattygggttttggtaaatgggatgttaataatagtttttaaatagaggattatatagtatttgygtgagtttattttttttttatgttttttaagtatgttatgagaataygtttgggttagtttgttgaaggagttgagttgagttatttyggtgatagttagttgatttttagtagtgagaggtatttttataaagttgttttgttgattattttagatataygagtaaaagaaatgtttattattatatgttattgag

SEQ ID NO: 480 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 22: mod_base = OTHER; note = uracil
  modified_base 27: mod_base = OTHER; note = uracil
  modified_base 33: mod_base = OTHER; note = uracil
  modified_base 42: mod_base = OTHER; note = uracil
  modified_base 52: mod_base = OTHER; note = uracil
  modified_base 55: mod_base = OTHER; note = uracil
  modified_base 60: mod_base = OTHER; note = uracil
  modified_base 63: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 81: mod_base = OTHER; note = uracil
  modified_base 83: mod_base = OTHER; note = uracil
  modified_base 86: mod_base = OTHER; note = uracil
  modified_base 94: mod_base = OTHER; note = uracil
  modified_base 97: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 116: mod_base = OTHER; note = uracil
  modified_base 118: mod_base = OTHER; note = uracil
  modified_base 121: mod_base = OTHER; note = uracil
  modified_base 123: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 132: mod_base = OTHER; note = uracil
  modified_base 135: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 155: mod_base = OTHER; note = uracil
  modified_base 157: mod_base = OTHER; note = uracil
  modified_base 162: mod_base = OTHER; note = uracil
  modified_base 166: mod_base = OTHER; note = uracil
  modified_base 175: mod_base = OTHER; note = uracil
  modified_base 192: mod_base = OTHER; note = uracil
  modified_base 194: mod_base = OTHER; note = uracil
  modified_base 198: mod_base = OTHER; note = uracil
  modified_base 204: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 227: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 248: mod_base = OTHER; note = uracil
  modified_base 249: mod_base = OTHER; note = uracil
  modified_base 254: mod_base = OTHER; note = uracil
  modified_base 255: mod_base = OTHER; note = uracil
  modified_base 281: mod_base = OTHER; note = uracil
  modified_base 282: mod_base = OTHER; note = uracil
  modified_base 285: mod_base = OTHER; note = uracil
  modified_base 287: mod_base = OTHER; note = uracil
  modified_base 299: mod_base = OTHER; note = uracil
ttagtgatatgtaatggtaaatattttttttgttygtgtgtttggggtggttagtagagtagttttgtgggggtgttttttattgttaagagttagttggttgttatygggatgatttagtttagtttttttagtaggttgatttaggygtgtttttatggtatgtttgaagaatataagaggggagtgggtttaygtaagtattatgtgattttttgtttgggagttgttgttaatattttatttgttaaagttyggattygaagggtaaggaaattggttattattttagtgagagta

SEQ ID NO: 481 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 4: mod_base = OTHER; note = uracil
  modified_base 7: mod_base = OTHER; note = uracil
  modified_base 8: mod_base = OTHER; note = uracil
  modified_base 12: mod_base = OTHER; note = uracil
  modified_base 13: mod_base = OTHER; note = uracil
  modified_base 15: mod_base = OTHER; note = uracil
  modified_base 20: mod_base = OTHER; note = uracil
  modified_base 23: mod_base = OTHER; note = uracil
  modified_base 24: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 31: mod_base = OTHER; note = uracil
  modified_base 33: mod_base = OTHER; note = uracil
  modified_base 34: mod_base = OTHER; note = uracil
  modified_base 39: mod_base = OTHER; note = uracil
  modified_base 43: mod_base = OTHER; note = uracil
  modified_base 46: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 70: mod_base = OTHER; note = uracil
  modified_base 76: mod_base = OTHER; note = uracil
  modified_base 79: mod_base = OTHER; note = uracil
  modified_base 81: mod_base = OTHER; note = uracil
  modified_base 82: mod_base = OTHER; note = uracil
  modified_base 89: mod_base = OTHER; note = uracil
  modified_base 90: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 103: mod_base = OTHER; note = uracil
  modified_base 106: mod_base = OTHER; note = uracil
  modified_base 112: mod_base = OTHER; note = uracil
  modified_base 118: mod_base = OTHER; note = uracil
  modified_base 119: mod_base = OTHER; note = uracil
  modified_base 127: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 144: mod_base = OTHER; note = uracil
  modified_base 145: mod_base = OTHER; note = uracil
  modified_base 147: mod_base = OTHER; note = uracil
  modified_base 148: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 167: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 180: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 211: mod_base = OTHER; note = uracil
  modified_base 216: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 232: mod_base = OTHER; note = uracil
  modified_base 235: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 247: mod_base = OTHER; note = uracil
  modified_base 249: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 272: mod_base = OTHER; note = uracil
  modified_base 277: mod_base = OTHER; note = uracil
  modified_base 279: mod_base = OTHER; note = uracil
  modified_base 283: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 297: mod_base = OTHER; note = uracil
  modified_base 299: mod_base = OTHER; note = uracil
ttttagttaaattattygattgttttttattatttatattggtygtttttttttggagtttgtatttaatagtggtaatattttgtggttygagtttttttttagtttggttagtggtttagtgagtatgattaatttatyggttttttygtttttagtattatttttagyggtttttttygttttygttttttagagtttatttttgagttgygtagtgttatttaaygatagtagttttatttatttagyggtatttattttttttaygtygaatattgatattttttttgagttata

SEQ ID NO: 482 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 8: mod_base = OTHER; note = uracil
  modified_base 20: mod_base = OTHER; note = uracil
  modified_base 47: mod_base = OTHER; note = uracil
  modified_base 50: mod_base = OTHER; note = uracil
  modified_base 64: mod_base = OTHER; note = uracil
  modified_base 67: mod_base = OTHER; note = uracil
  modified_base 81: mod_base = OTHER; note = uracil
  modified_base 83: mod_base = OTHER; note = uracil
  modified_base 88: mod_base = OTHER; note = uracil
  modified_base 91: mod_base = OTHER; note = uracil
  modified_base 93: mod_base = OTHER; note = uracil
  modified_base 103: mod_base = OTHER; note = uracil
  modified_base 105: mod_base = OTHER; note = uracil
  modified_base 128: mod_base = OTHER; note = uracil
  modified_base 131: mod_base = OTHER; note = uracil
  modified_base 143: mod_base = OTHER; note = uracil
  modified_base 158: mod_base = OTHER; note = uracil
  modified_base 171: mod_base = OTHER; note = uracil
  modified_base 175: mod_base = OTHER; note = uracil
  modified_base 177: mod_base = OTHER; note = uracil
  modified_base 179: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 207: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 226: mod_base = OTHER; note = uracil
  modified_base 227: mod_base = OTHER; note = uracil
  modified_base 229: mod_base = OTHER; note = uracil
  modified_base 239: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 259: mod_base = OTHER; note = uracil
  modified_base 260: mod_base = OTHER; note = uracil
  modified_base 279: mod_base = OTHER; note = uracil
  modified_base 295: mod_base = OTHER; note = uracil
tgtggtttagggaaaatgttagtgttyggygtggggaaggtgggtgtygttgagtaaatgggattgttgtygttggatggtattgygtagtttaggggtgggttttgggaggyggaggyggaggaggtygttggagatggtgttgaggaygaggaggtyggtgggttggttatgtttattaggttattgattaagttgaagaggggttygggttataaggtgttgttattgttgggtgtaggttttagggaaaagyggttagtataggtgatggggggtagtygagtggtttggttgggg

SEQ ID NO: 483 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 23: mod_base = OTHER; note = uracil
  modified_base 24: mod_base = OTHER; note = uracil
  modified_base 31: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 69: mod_base = OTHER; note = uracil
  modified_base 73: mod_base = OTHER; note = uracil
  modified_base 75: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 95: mod_base = OTHER; note = uracil
  modified_base 99: mod_base = OTHER; note = uracil
  modified_base 104: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 111: mod_base = OTHER; note = uracil
  modified_base 118: mod_base = OTHER; note = uracil
  modified_base 131: mod_base = OTHER; note = uracil
  modified_base 137: mod_base = OTHER; note = uracil
  modified_base 144: mod_base = OTHER; note = uracil
  modified_base 148: mod_base = OTHER; note = uracil
  modified_base 149: mod_base = OTHER; note = uracil
  modified_base 154: mod_base = OTHER; note = uracil
  modified_base 157: mod_base = OTHER; note = uracil
  modified_base 160: mod_base = OTHER; note = uracil
  modified_base 161: mod_base = OTHER; note = uracil
  modified_base 170: mod_base = OTHER; note = uracil
  modified_base 180: mod_base = OTHER; note = uracil
  modified_base 181: mod_base = OTHER; note = uracil
  modified_base 187: mod_base = OTHER; note = uracil
  modified_base 189: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 235: mod_base = OTHER; note = uracil
  modified_base 240: mod_base = OTHER; note = uracil
  modified_base 241: mod_base = OTHER; note = uracil
  modified_base 246: mod_base = OTHER; note = uracil
  modified_base 247: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 266: mod_base = OTHER; note = uracil
  modified_base 269: mod_base = OTHER; note = uracil
  modified_base 271: mod_base = OTHER; note = uracil
  modified_base 274: mod_base = OTHER; note = uracil
  modified_base 277: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 291: mod_base = OTHER; note = uracil
  modified_base 292: mod_base = OTHER; note = uracil
  modified_base 294: mod_base = OTHER; note = uracil
  modified_base 295: mod_base = OTHER; note = uracil
  modified_base 296: mod_base = OTHER; note = uracil
  modified_base 298: mod_base = OTHER; note = uracil
  modified_base 299: mod_base = OTHER; note = uracil
gtagtggttgggtttttattttttaggaaatttaaaattttgggttagtygygggtggygggttggggtaggtataaagagggtttttgtgyggtyggttgggttgtttataggattttgggggaggaggtyggagtyggttttygtttygttttgttttttgyggaggttgyggaatgttyggagttttggtttagtttgtttygtttggtttattygtagttttttttttattttttttagggttttggggtatagttgtagatttttttgtaatagggttttgagagttatttttta

SEQ ID NO: 484 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 13: mod_base = OTHER; note = uracil
  modified_base 15: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 28: mod_base = OTHER; note = uracil
  modified_base 37: mod_base = OTHER; note = uracil
  modified_base 40: mod_base = OTHER; note = uracil
  modified_base 43: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 79: mod_base = OTHER; note = uracil
  modified_base 90: mod_base = OTHER; note = uracil
  modified_base 91: mod_base = OTHER; note = uracil
  modified_base 100: mod_base = OTHER; note = uracil
  modified_base 104: mod_base = OTHER; note = uracil
  modified_base 109: mod_base = OTHER; note = uracil
  modified_base 110: mod_base = OTHER; note = uracil
  modified_base 115: mod_base = OTHER; note = uracil
  modified_base 117: mod_base = OTHER; note = uracil
  modified_base 122: mod_base = OTHER; note = uracil
  modified_base 126: mod_base = OTHER; note = uracil
  modified_base 129: mod_base = OTHER; note = uracil
  modified_base 132: mod_base = OTHER; note = uracil
  modified_base 133: mod_base = OTHER; note = uracil
  modified_base 135: mod_base = OTHER; note = uracil
  modified_base 138: mod_base = OTHER; note = uracil
  modified_base 145: mod_base = OTHER; note = uracil
  modified_base 161: mod_base = OTHER; note = uracil
  modified_base 165: mod_base = OTHER; note = uracil
  modified_base 167: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 187: mod_base = OTHER; note = uracil
  modified_base 188: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 203: mod_base = OTHER; note = uracil
  modified_base 207: mod_base = OTHER; note = uracil
  modified_base 210: mod_base = OTHER; note = uracil
  modified_base 212: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 222: mod_base = OTHER; note = uracil
  modified_base 229: mod_base = OTHER; note = uracil
  modified_base 230: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 239: mod_base = OTHER; note = uracil
  modified_base 240: mod_base = OTHER; note = uracil
  modified_base 243: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 274: mod_base = OTHER; note = uracil
  modified_base 275: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 295: mod_base = OTHER; note = uracil
  modified_base 297: mod_base = OTHER; note = uracil
  modified_base 300: mod_base = OTHER; note = uracil
tggagggtggtttttagggttttgttgtagagaagtttgtagttgtattttaaggttttggaaaagatggggaaggggttgygggtgggttagayggggtaggttgggttagagtttygggtatttygtagttttygtaggaagtagaaygggayggaaatyggtttyggtttttttttttagaattttgtgggtagtttagtyggtygtatagaggttttttttgtgtttgttttaattygttattygyggttggtttagggttttgagttttttggggggtgggggtttagttattgt

SEQ ID NO: 485 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 7: mod_base = OTHER; note = uracil
  modified_base 11: mod_base = OTHER; note = uracil
  modified_base 13: mod_base = OTHER; note = uracil
  modified_base 18: mod_base = OTHER; note = uracil
  modified_base 19: mod_base = OTHER; note = uracil
  modified_base 23: mod_base = OTHER; note = uracil
  modified_base 59: mod_base = OTHER; note = uracil
  modified_base 61: mod_base = OTHER; note = uracil
  modified_base 70: mod_base = OTHER; note = uracil
  modified_base 71: mod_base = OTHER; note = uracil
  modified_base 80: mod_base = OTHER; note = uracil
  modified_base 82: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 127: mod_base = OTHER; note = uracil
  modified_base 136: mod_base = OTHER; note = uracil
  modified_base 146: mod_base = OTHER; note = uracil
  modified_base 149: mod_base = OTHER; note = uracil
  modified_base 152: mod_base = OTHER; note = uracil
  modified_base 154: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 166: mod_base = OTHER; note = uracil
  modified_base 172: mod_base = OTHER; note = uracil
  modified_base 176: mod_base = OTHER; note = uracil
  modified_base 181: mod_base = OTHER; note = uracil
  modified_base 183: mod_base = OTHER; note = uracil
  modified_base 188: mod_base = OTHER; note = uracil
  modified_base 189: mod_base = OTHER; note = uracil
  modified_base 197: mod_base = OTHER; note = uracil
  modified_base 201: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 217: mod_base = OTHER; note = uracil
  modified_base 237: mod_base = OTHER; note = uracil
  modified_base 238: mod_base = OTHER; note = uracil
  modified_base 242: mod_base = OTHER; note = uracil
  modified_base 244: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 262: mod_base = OTHER; note = uracil
  modified_base 267: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 281: mod_base = OTHER; note = uracil
  modified_base 288: mod_base = OTHER; note = uracil
  modified_base 289: mod_base = OTHER; note = uracil
  modified_base 292: mod_base = OTHER; note = uracil
  modified_base 294: mod_base = OTHER; note = uracil
  modified_base 297: mod_base = OTHER; note = uracil
  modified_base 298: mod_base = OTHER; note = uracil
aggtattygttataaygttyggttaatttttttgtattttttagtagagayggggttttatygtgttagttaggatggttttagttttttgattttgtgatttatttattttagttttttaaagtgttgggattatagatgtgagttatygtattyggttaagtttatgatttttttgtattttgagttagtgttattggtaaagaatgttttgggtattgtggtgtggatggaagttaggtatattgtatttatttttttttagattaagttgtttggtttgtggatttttttagttag

SEQ ID NO: 486 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 15: mod_base = OTHER; note = uracil
  modified_base 16: mod_base = OTHER; note = uracil
  modified_base 18: mod_base = OTHER; note = uracil
  modified_base 22: mod_base = OTHER; note = uracil
  modified_base 23: mod_base = OTHER; note = uracil
  modified_base 27: mod_base = OTHER; note = uracil
  modified_base 30: mod_base = OTHER; note = uracil
  modified_base 36: mod_base = OTHER; note = uracil
  modified_base 53: mod_base = OTHER; note = uracil
  modified_base 60: mod_base = OTHER; note = uracil
  modified_base 61: mod_base = OTHER; note = uracil
  modified_base 65: mod_base = OTHER; note = uracil
  modified_base 68: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 96: mod_base = OTHER; note = uracil
  modified_base 101: mod_base = OTHER; note = uracil
  modified_base 102: mod_base = OTHER; note = uracil
  modified_base 108: mod_base = OTHER; note = uracil
  modified_base 110: mod_base = OTHER; note = uracil
  modified_base 114: mod_base = OTHER; note = uracil
  modified_base 116: mod_base = OTHER; note = uracil
  modified_base 123: mod_base = OTHER; note = uracil
  modified_base 132: mod_base = OTHER; note = uracil
  modified_base 138: mod_base = OTHER; note = uracil
  modified_base 143: mod_base = OTHER; note = uracil
  modified_base 156: mod_base = OTHER; note = uracil
  modified_base 158: mod_base = OTHER; note = uracil
  modified_base 160: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 175: mod_base = OTHER; note = uracil
  modified_base 177: mod_base = OTHER; note = uracil
  modified_base 187: mod_base = OTHER; note = uracil
  modified_base 202: mod_base = OTHER; note = uracil
  modified_base 204: mod_base = OTHER; note = uracil
  modified_base 210: mod_base = OTHER; note = uracil
  modified_base 217: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 228: mod_base = OTHER; note = uracil
  modified_base 232: mod_base = OTHER; note = uracil
  modified_base 236: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 267: mod_base = OTHER; note = uracil
  modified_base 279: mod_base = OTHER; note = uracil
  modified_base 298: mod_base = OTHER; note = uracil
  modified_base 299: mod_base = OTHER; note = uracil
ttggttgagaaggtttataggttaggtaatttagtttaggaaggaatggatgtaatgtgtttggtttttatttatattataatgtttagggtattttttgttagtaatattggtttagagtatagaaagattatgaatttggtygggtgyggtagtttatatttgtaattttagtattttgggaggttgaggtgggtggattataaggttaggagattgagattattttggttaatayggtgaaatttygtttttattaaaaaatataaaaaaattagtygggygttgtgaygggtgttt

SEQ ID NO: 487 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 14: mod_base = OTHER; note = uracil
  modified_base 17: mod_base = OTHER; note = uracil
  modified_base 18: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 49: mod_base = OTHER; note = uracil
  modified_base 51: mod_base = OTHER; note = uracil
  modified_base 55: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 96: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 104: mod_base = OTHER; note = uracil
  modified_base 107: mod_base = OTHER; note = uracil
  modified_base 110: mod_base = OTHER; note = uracil
  modified_base 118: mod_base = OTHER; note = uracil
  modified_base 132: mod_base = OTHER; note = uracil
  modified_base 136: mod_base = OTHER; note = uracil
  modified_base 137: mod_base = OTHER; note = uracil
  modified_base 143: mod_base = OTHER; note = uracil
  modified_base 148: mod_base = OTHER; note = uracil
  modified_base 151: mod_base = OTHER; note = uracil
  modified_base 152: mod_base = OTHER; note = uracil
  modified_base 157: mod_base = OTHER; note = uracil
  modified_base 159: mod_base = OTHER; note = uracil
  modified_base 160: mod_base = OTHER; note = uracil
  modified_base 165: mod_base = OTHER; note = uracil
  modified_base 166: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 212: mod_base = OTHER; note = uracil
  modified_base 216: mod_base = OTHER; note = uracil
  modified_base 223: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 240: mod_base = OTHER; note = uracil
  modified_base 241: mod_base = OTHER; note = uracil
  modified_base 252: mod_base = OTHER; note = uracil
  modified_base 258: mod_base = OTHER; note = uracil
  modified_base 259: mod_base = OTHER; note = uracil
  modified_base 265: mod_base = OTHER; note = uracil
  modified_base 266: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 272: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 294: mod_base = OTHER; note = uracil
  modified_base 295: mod_base = OTHER; note = uracil
  modified_base 297: mod_base = OTHER; note = uracil
tttygtggggatgtaatttygtttgtttttttgatttttttatgagatttttygtttttttttatattttttttattttttaattttttgtyggtttattaggttgtagttgygggtttgygggtaggggatatttttaggttttgatygttagagtattyggtttagtttyggttatagtttttggtttaagtgagggttggtttggggataagtygaaattagggttttggttgtatttagaaagagaattgagattygttgttttttattgggttatttttygattttaattatata

SEQ ID NO: 488 - DNA, 300 bp, synthetic construct
  misc_feature 1..300: note = Synthetic polynucleotide
  source 1..300: mol_type = other DNA
  modified_base 24: mod_base = OTHER; note = uracil
  modified_base 25: mod_base = OTHER; note = uracil
  modified_base 26: mod_base = OTHER; note = uracil
  modified_base 36: mod_base = OTHER; note = uracil
  modified_base 44: mod_base = OTHER; note = uracil
  modified_base 46: mod_base = OTHER; note = uracil
  modified_base 51: mod_base = OTHER; note = uracil
  modified_base 53: mod_base = OTHER; note = uracil
  modified_base 57: mod_base = OTHER; note = uracil
  modified_base 64: mod_base = OTHER; note = uracil
  modified_base 67: mod_base = OTHER; note = uracil
  modified_base 68: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 85: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 105: mod_base = OTHER; note = uracil
  modified_base 107: mod_base = OTHER; note = uracil
  modified_base 113: mod_base = OTHER; note = uracil
  modified_base 114: mod_base = OTHER; note = uracil
  modified_base 120: mod_base = OTHER; note = uracil
  modified_base 126: mod_base = OTHER; note = uracil
  modified_base 132: mod_base = OTHER; note = uracil
  modified_base 137: mod_base = OTHER; note = uracil
  modified_base 144: mod_base = OTHER; note = uracil
  modified_base 146: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 184: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 194: mod_base = OTHER; note = uracil
  modified_base 197: mod_base = OTHER; note = uracil
  modified_base 198: mod_base = OTHER; note = uracil
  modified_base 206: mod_base = OTHER; note = uracil
  modified_base 210: mod_base = OTHER; note = uracil
  modified_base 254: mod_base = OTHER; note = uracil
  modified_base 256: mod_base = OTHER; note = uracil
  modified_base 267: mod_base = OTHER; note = uracil
  modified_base 275: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 292: mod_base = OTHER; note = uracil
  modified_base 293: mod_base = OTHER; note = uracil
atgtggttggggtyggggggtggtttagtgggaggtaaygggttttagttttttttttggatatagttagggttttgatttyggtttgtttttaggttagtttttatttgggttaaaggttgtggtygggattggatygggtgttttggyggttaagatttaggaatgttttttattygtagattygtagttgtagtttggtggatyggtagggggttgggggataaaggaggtgtgggaggaagygagagattttatggggaagttagaggggtaaaygaggttgtatttttayggaat

SEQ ID NO: 489 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 8: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 23: mod_base = OTHER; note = uracil
  modified_base 24: mod_base = OTHER; note = uracil
  modified_base 29: mod_base = OTHER; note = uracil
  modified_base 33: mod_base = OTHER; note = uracil
  modified_base 34: mod_base = OTHER; note = uracil
  modified_base 38: mod_base = OTHER; note = uracil
  modified_base 39: mod_base = OTHER; note = uracil
  modified_base 44: mod_base = OTHER; note = uracil
  modified_base 46: mod_base = OTHER; note = uracil
  modified_base 47: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 62: mod_base = OTHER; note = uracil
  modified_base 65: mod_base = OTHER; note = uracil
  modified_base 67: mod_base = OTHER; note = uracil
  modified_base 70: mod_base = OTHER; note = uracil
  modified_base 72: mod_base = OTHER; note = uracil
  modified_base 77: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 88: mod_base = OTHER; note = uracil
  modified_base 89: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 99: mod_base = OTHER; note = uracil
  modified_base 105: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 148: mod_base = OTHER; note = uracil
  modified_base 156: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 167: mod_base = OTHER; note = uracil
  modified_base 173: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 190: mod_base = OTHER; note = uracil
  modified_base 194: mod_base = OTHER; note = uracil
  modified_base 198: mod_base = OTHER; note = uracil
  modified_base 199: mod_base = OTHER; note = uracil
  modified_base 203: mod_base = OTHER; note = uracil
  modified_base 204: mod_base = OTHER; note = uracil
  modified_base 210: mod_base = OTHER; note = uracil
  modified_base 212: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 234: mod_base = OTHER; note = uracil
  modified_base 236: mod_base = OTHER; note = uracil
  modified_base 237: mod_base = OTHER; note = uracil
  modified_base 242: mod_base = OTHER; note = uracil
  modified_base 251: mod_base = OTHER; note = uracil
  modified_base 255: mod_base = OTHER; note = uracil
  modified_base 256: mod_base = OTHER; note = uracil
  modified_base 257: mod_base = OTHER; note = uracil
  modified_base 258: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 277: mod_base = OTHER; note = uracil
  modified_base 282: mod_base = OTHER; note = uracil
  modified_base 283: mod_base = OTHER; note = uracil
  modified_base 297: mod_base = OTHER; note = uracil
  modified_base 300: mod_base = OTHER; note = uracil
tttatattyggttttygtttttttagygtyggtttygttygygtttttgagaaagttttgttygtttygtttayggtygtgttttggttaattttttgttgyggtyggygggttttgggaagttygtgtttttttttttgttygggtttygaggatttttttttggtaggygttggggttttttgagagtaggtaggttyggtttttgttttygygaggtttatttyggttygtattttygttttgyggtttgattttaygygtttttttgtagggttgggttygggtgaggggagtttt

SEQ ID NO: 490 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 25: mod_base = OTHER; note = uracil
  modified_base 26: mod_base = OTHER; note = uracil
  modified_base 27: mod_base = OTHER; note = uracil
  modified_base 30: mod_base = OTHER; note = uracil
  modified_base 48: mod_base = OTHER; note = uracil
  modified_base 52: mod_base = OTHER; note = uracil
  modified_base 55: mod_base = OTHER; note = uracil
  modified_base 72: mod_base = OTHER; note = uracil
  modified_base 82: mod_base = OTHER; note = uracil
  modified_base 83: mod_base = OTHER; note = uracil
  modified_base 93: mod_base = OTHER; note = uracil
  modified_base 99: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 114: mod_base = OTHER; note = uracil
  modified_base 116: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 136: mod_base = OTHER; note = uracil
  modified_base 147: mod_base = OTHER; note = uracil
  modified_base 148: mod_base = OTHER; note = uracil
  modified_base 155: mod_base = OTHER; note = uracil
  modified_base 156: mod_base = OTHER; note = uracil
  modified_base 161: mod_base = OTHER; note = uracil
  modified_base 173: mod_base = OTHER; note = uracil
  modified_base 179: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 189: mod_base = OTHER; note = uracil
  modified_base 190: mod_base = OTHER; note = uracil
  modified_base 193: mod_base = OTHER; note = uracil
  modified_base 197: mod_base = OTHER; note = uracil
  modified_base 200: mod_base = OTHER; note = uracil
  modified_base 203: mod_base = OTHER; note = uracil
  modified_base 214: mod_base = OTHER; note = uracil
  modified_base 215: mod_base = OTHER; note = uracil
  modified_base 220: mod_base = OTHER; note = uracil
  modified_base 225: mod_base = OTHER; note = uracil
  modified_base 241: mod_base = OTHER; note = uracil
  modified_base 246: mod_base = OTHER; note = uracil
  modified_base 250: mod_base = OTHER; note = uracil
  modified_base 252: mod_base = OTHER; note = uracil
  modified_base 269: mod_base = OTHER; note = uracil
  modified_base 275: mod_base = OTHER; note = uracil
  modified_base 290: mod_base = OTHER; note = uracil
gaagttttttttattygggtttagttttgtaggggggygygtggggttagatygtaaagygaaggtgygggtyggggtgggtttygyggagataaaggtygggtttgtttgtttttagagggttttagygtttgttaagaggaagttttygaggttygggtagggaagggggtaygggttttttagggttygtyggtygtagtaggaagttggttagggtayggtygtgagyggagygggtagggtttttttaggagygygggygaggtyggygttggaggggygaggatygggtataag

SEQ ID NO: 491 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 6: mod_base = OTHER; note = uracil
  modified_base 12: mod_base = OTHER; note = uracil
  modified_base 21: mod_base = OTHER; note = uracil
  modified_base 24: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 52: mod_base = OTHER; note = uracil
  modified_base 77: mod_base = OTHER; note = uracil
  modified_base 78: mod_base = OTHER; note = uracil
  modified_base 84: mod_base = OTHER; note = uracil
  modified_base 86: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 110: mod_base = OTHER; note = uracil
  modified_base 115: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 129: mod_base = OTHER; note = uracil
  modified_base 131: mod_base = OTHER; note = uracil
  modified_base 134: mod_base = OTHER; note = uracil
  modified_base 139: mod_base = OTHER; note = uracil
  modified_base 142: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 161: mod_base = OTHER; note = uracil
  modified_base 163: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 273: mod_base = OTHER; note = uracil
  modified_base 274: mod_base = OTHER; note = uracil
  modified_base 277: mod_base = OTHER; note = uracil
  modified_base 292: mod_base = OTHER; note = uracil
  modified_base 296: mod_base = OTHER; note = uracil
agtttttttattagaaagggtagtygtagagttygygtgtgygygatgtggttgygggtggggagygggyggygggttygggatatygyggttattgttttagtttygtttgggtygtttgatygyggtttygttgygtygtagtttygygtttttttggtttttgttttygggygyggggagaaggyggyggggygygtttgggttygygygggtgygaaygygaggttttttttgggtgtttttaggtyggaggatttttagggygggggttattagggtggygaggaatyggtaggg

SEQ ID NO: 492 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 6: mod_base = OTHER; note = uracil
  modified_base 12: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 22: mod_base = OTHER; note = uracil
  modified_base 29: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 35: mod_base = OTHER; note = uracil
  modified_base 36: mod_base = OTHER; note = uracil
  modified_base 37: mod_base = OTHER; note = uracil
  modified_base 45: mod_base = OTHER; note = uracil
  modified_base 46: mod_base = OTHER; note = uracil
  modified_base 48: mod_base = OTHER; note = uracil
  modified_base 52: mod_base = OTHER; note = uracil
  modified_base 53: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 73: mod_base = OTHER; note = uracil
  modified_base 74: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 111: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 127: mod_base = OTHER; note = uracil
  modified_base 128: mod_base = OTHER; note = uracil
  modified_base 135: mod_base = OTHER; note = uracil
  modified_base 141: mod_base = OTHER; note = uracil
  modified_base 142: mod_base = OTHER; note = uracil
  modified_base 157: mod_base = OTHER; note = uracil
  modified_base 165: mod_base = OTHER; note = uracil
  modified_base 173: mod_base = OTHER; note = uracil
  modified_base 180: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 198: mod_base = OTHER; note = uracil
  modified_base 204: mod_base = OTHER; note = uracil
  modified_base 210: mod_base = OTHER; note = uracil
  modified_base 219: mod_base = OTHER; note = uracil
  modified_base 220: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 260: mod_base = OTHER; note = uracil
  modified_base 262: mod_base = OTHER; note = uracil
  modified_base 270: mod_base = OTHER; note = uracil
  modified_base 272: mod_base = OTHER; note = uracil
  modified_base 278: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 287: mod_base = OTHER; note = uracil
  modified_base 299: mod_base = OTHER; note = uracil
ttttgtyggtttttygttattttgatggttttygttttgggaatttttygatttgggagtatttaggaaagatttygygttygtattygygygggtttaggygygtttygtygtttttttttygygttygggaataggagttagaggggygyggggttgyggygtagyggagtygyggttaggyggtttaggyggggttagaatagtggtygyggtgtttygggttygtygttygttttttattygtagttatatygygtataygygggttttgyggttgttttttttgataaaggagtt

SEQ ID NO: 493 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 10: mod_base = OTHER; note = uracil
  modified_base 13: mod_base = OTHER; note = uracil
  modified_base 18: mod_base = OTHER; note = uracil
  modified_base 22: mod_base = OTHER; note = uracil
  modified_base 28: mod_base = OTHER; note = uracil
  modified_base 31: mod_base = OTHER; note = uracil
  modified_base 34: mod_base = OTHER; note = uracil
  modified_base 38: mod_base = OTHER; note = uracil
  modified_base 40: mod_base = OTHER; note = uracil
  modified_base 60: mod_base = OTHER; note = uracil
  modified_base 61: mod_base = OTHER; note = uracil
  modified_base 73: mod_base = OTHER; note = uracil
  modified_base 81: mod_base = OTHER; note = uracil
  modified_base 83: mod_base = OTHER; note = uracil
  modified_base 86: mod_base = OTHER; note = uracil
  modified_base 94: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 107: mod_base = OTHER; note = uracil
  modified_base 114: mod_base = OTHER; note = uracil
  modified_base 127: mod_base = OTHER; note = uracil
  modified_base 131: mod_base = OTHER; note = uracil
  modified_base 137: mod_base = OTHER; note = uracil
  modified_base 138: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 149: mod_base = OTHER; note = uracil
  modified_base 164: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 175: mod_base = OTHER; note = uracil
  modified_base 180: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 192: mod_base = OTHER; note = uracil
  modified_base 197: mod_base = OTHER; note = uracil
  modified_base 208: mod_base = OTHER; note = uracil
  modified_base 214: mod_base = OTHER; note = uracil
  modified_base 235: mod_base = OTHER; note = uracil
  modified_base 237: mod_base = OTHER; note = uracil
  modified_base 246: mod_base = OTHER; note = uracil
  modified_base 247: mod_base = OTHER; note = uracil
  modified_base 253: mod_base = OTHER; note = uracil
  modified_base 256: mod_base = OTHER; note = uracil
  modified_base 259: mod_base = OTHER; note = uracil
  modified_base 265: mod_base = OTHER; note = uracil
  modified_base 267: mod_base = OTHER; note = uracil
  modified_base 269: mod_base = OTHER; note = uracil
  modified_base 279: mod_base = OTHER; note = uracil
  modified_base 283: mod_base = OTHER; note = uracil
  modified_base 291: mod_base = OTHER; note = uracil
  modified_base 300: mod_base = OTHER; note = uracil
tggaaaagttaattgtgtaaatattygtttttatygttataaggtgaaaaggaaaaatgttaaaaaggagagtttggaaatatagtagaagagtaatgattttttgtagagaatatgaaataagattyggtagtgattttattaaagatayggaaaataaggtttaatttagaattggttagagaatattattgtgttttagagtaataattataaaggaaaagagggatygggtattgtaatatttygggattgtagtttgtattttttgggtggtgtattttgtaatttaattaaatt

SEQ ID NO: 494 - DNA, 300 bp, synthetic construct
  misc_feature 1..300: note = Synthetic polynucleotide
  source 1..300: mol_type = other DNA
  modified_base 16: mod_base = OTHER; note = uracil
  modified_base 23: mod_base = OTHER; note = uracil
  modified_base 25: mod_base = OTHER; note = uracil
  modified_base 26: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 39: mod_base = OTHER; note = uracil
  modified_base 43: mod_base = OTHER; note = uracil
  modified_base 46: mod_base = OTHER; note = uracil
  modified_base 50: mod_base = OTHER; note = uracil
  modified_base 51: mod_base = OTHER; note = uracil
  modified_base 62: mod_base = OTHER; note = uracil
  modified_base 67: mod_base = OTHER; note = uracil
  modified_base 68: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 82: mod_base = OTHER; note = uracil
  modified_base 83: mod_base = OTHER; note = uracil
  modified_base 97: mod_base = OTHER; note = uracil
  modified_base 99: mod_base = OTHER; note = uracil
  modified_base 105: mod_base = OTHER; note = uracil
  modified_base 107: mod_base = OTHER; note = uracil
  modified_base 117: mod_base = OTHER; note = uracil
  modified_base 119: mod_base = OTHER; note = uracil
  modified_base 123: mod_base = OTHER; note = uracil
  modified_base 124: mod_base = OTHER; note = uracil
  modified_base 129: mod_base = OTHER; note = uracil
  modified_base 139: mod_base = OTHER; note = uracil
  modified_base 140: mod_base = OTHER; note = uracil
  modified_base 148: mod_base = OTHER; note = uracil
  modified_base 154: mod_base = OTHER; note = uracil
  modified_base 166: mod_base = OTHER; note = uracil
  modified_base 168: mod_base = OTHER; note = uracil
  modified_base 171: mod_base = OTHER; note = uracil
  modified_base 177: mod_base = OTHER; note = uracil
  modified_base 184: mod_base = OTHER; note = uracil
  modified_base 190: mod_base = OTHER; note = uracil
  modified_base 192: mod_base = OTHER; note = uracil
  modified_base 195: mod_base = OTHER; note = uracil
  modified_base 203: mod_base = OTHER; note = uracil
  modified_base 208: mod_base = OTHER; note = uracil
  modified_base 210: mod_base = OTHER; note = uracil
  modified_base 213: mod_base = OTHER; note = uracil
  modified_base 216: mod_base = OTHER; note = uracil
  modified_base 224: mod_base = OTHER; note = uracil
  modified_base 225: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 234: mod_base = OTHER; note = uracil
  modified_base 242: mod_base = OTHER; note = uracil
  modified_base 249: mod_base = OTHER; note = uracil
  modified_base 250: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 284: mod_base = OTHER; note = uracil
  modified_base 286: mod_base = OTHER; note = uracil
  modified_base 293: mod_base = OTHER; note = uracil
  modified_base 298: mod_base = OTHER; note = uracil
  modified_base 299: mod_base = OTHER; note = uracil
gatttaattgaattatagaatgtattatttagagagtataagttgtagtttygggatattatagtgttygatttttttttttttttgtaattgttattttaaagtatagtggtgttttttgattagttttgggttggattttatttttygtgtttttagtggggttattgtyggattttattttatgttttttgtagggggttattgtttttttgttgtgtttttaagtttttttttttggtattttttttttttattttgtgayggtagaagygaatgtttgtatagttggttttttta

SEQ ID NO: 495 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 12: mod_base = OTHER; note = uracil
  modified_base 14: mod_base = OTHER; note = uracil
  modified_base 22: mod_base = OTHER; note = uracil
  modified_base 24: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 46: mod_base = OTHER; note = uracil
  modified_base 52: mod_base = OTHER; note = uracil
  modified_base 58: mod_base = OTHER; note = uracil
  modified_base 66: mod_base = OTHER; note = uracil
  modified_base 73: mod_base = OTHER; note = uracil
  modified_base 79: mod_base = OTHER; note = uracil
  modified_base 82: mod_base = OTHER; note = uracil
  modified_base 87: mod_base = OTHER; note = uracil
  modified_base 98: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 119: mod_base = OTHER; note = uracil
  modified_base 120: mod_base = OTHER; note = uracil
  modified_base 123: mod_base = OTHER; note = uracil
  modified_base 135: mod_base = OTHER; note = uracil
  modified_base 142: mod_base = OTHER; note = uracil
  modified_base 144: mod_base = OTHER; note = uracil
  modified_base 148: mod_base = OTHER; note = uracil
  modified_base 153: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 174: mod_base = OTHER; note = uracil
  modified_base 176: mod_base = OTHER; note = uracil
  modified_base 177: mod_base = OTHER; note = uracil
  modified_base 182: mod_base = OTHER; note = uracil
  modified_base 188: mod_base = OTHER; note = uracil
  modified_base 192: mod_base = OTHER; note = uracil
  modified_base 201: mod_base = OTHER; note = uracil
  modified_base 202: mod_base = OTHER; note = uracil
  modified_base 211: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 243: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 252: mod_base = OTHER; note = uracil
  modified_base 260: mod_base = OTHER; note = uracil
  modified_base 261: mod_base = OTHER; note = uracil
  modified_base 267: mod_base = OTHER; note = uracil
  modified_base 270: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 277: mod_base = OTHER; note = uracil
  modified_base 279: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 293: mod_base = OTHER; note = uracil
  modified_base 294: mod_base = OTHER; note = uracil
  modified_base 295: mod_base = OTHER; note = uracil
ttgtagattgatattgttaattataaataagtttagggttgtgtttagagataaagttagtgtgatyggtgattgttatagtaatataaaataatggtagtagttttattagtygaggttagtatygaatagggtaagttatttaaataygttattttagygattattttaaatatttgtgtttaaattaatttagggagttyggttttgtaggatgtgtaattaygttgtgttttttagggtttattagattttagtatttaatgtagttatttttatygtggtttaggtttttaggga

SEQ ID NO: 496 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 10: mod_base = OTHER; note = uracil
  modified_base 11: mod_base = OTHER; note = uracil
  modified_base 16: mod_base = OTHER; note = uracil
  modified_base 17: mod_base = OTHER; note = uracil
  modified_base 31: mod_base = OTHER; note = uracil
  modified_base 34: mod_base = OTHER; note = uracil
  modified_base 43: mod_base = OTHER; note = uracil
  modified_base 50: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 68: mod_base = OTHER; note = uracil
  modified_base 70: mod_base = OTHER; note = uracil
  modified_base 81: mod_base = OTHER; note = uracil
  modified_base 83: mod_base = OTHER; note = uracil
  modified_base 86: mod_base = OTHER; note = uracil
  modified_base 87: mod_base = OTHER; note = uracil
  modified_base 90: mod_base = OTHER; note = uracil
  modified_base 95: mod_base = OTHER; note = uracil
  modified_base 100: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 119: mod_base = OTHER; note = uracil
  modified_base 121: mod_base = OTHER; note = uracil
  modified_base 140: mod_base = OTHER; note = uracil
  modified_base 162: mod_base = OTHER; note = uracil
  modified_base 166: mod_base = OTHER; note = uracil
  modified_base 167: mod_base = OTHER; note = uracil
  modified_base 168: mod_base = OTHER; note = uracil
  modified_base 178: mod_base = OTHER; note = uracil
  modified_base 182: mod_base = OTHER; note = uracil
  modified_base 183: mod_base = OTHER; note = uracil
  modified_base 188: mod_base = OTHER; note = uracil
  modified_base 197: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 219: mod_base = OTHER; note = uracil
  modified_base 225: mod_base = OTHER; note = uracil
  modified_base 229: mod_base = OTHER; note = uracil
  modified_base 231: mod_base = OTHER; note = uracil
  modified_base 236: mod_base = OTHER; note = uracil
  modified_base 238: mod_base = OTHER; note = uracil
  modified_base 240: mod_base = OTHER; note = uracil
  modified_base 244: mod_base = OTHER; note = uracil
  modified_base 250: mod_base = OTHER; note = uracil
  modified_base 252: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 269: mod_base = OTHER; note = uracil
  modified_base 284: mod_base = OTHER; note = uracil
  modified_base 290: mod_base = OTHER; note = uracil
  modified_base 294: mod_base = OTHER; note = uracil
  modified_base 297: mod_base = OTHER; note = uracil
ttttgggaatttgggttayggtgagggtagttgtattaggtattaaagtttggtgagttttagggggtataaygtggttgtatattttgtaaaatygggttttttaagttagtttaagtataggtgtttggagtggtygttagggtgaygtgtttgagtaatttgttttattygatgttggtttyggttagtgggattgttgttattattttgtattgttgtaatagttatyggttatattgattttgtttttgaatataattttgggtttgtttgtgattaatagtgttaatttgtagg

SEQ ID NO: 497 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 9: mod_base = OTHER; note = uracil
  modified_base 10: mod_base = OTHER; note = uracil
  modified_base 14: mod_base = OTHER; note = uracil
  modified_base 19: mod_base = OTHER; note = uracil
  modified_base 23: mod_base = OTHER; note = uracil
  modified_base 24: mod_base = OTHER; note = uracil
  modified_base 26: mod_base = OTHER; note = uracil
  modified_base 30: mod_base = OTHER; note = uracil
  modified_base 31: mod_base = OTHER; note = uracil
  modified_base 33: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 44: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 64: mod_base = OTHER; note = uracil
  modified_base 65: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 84: mod_base = OTHER; note = uracil
  modified_base 91: mod_base = OTHER; note = uracil
  modified_base 102: mod_base = OTHER; note = uracil
  modified_base 103: mod_base = OTHER; note = uracil
  modified_base 107: mod_base = OTHER; note = uracil
  modified_base 112: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 121: mod_base = OTHER; note = uracil
  modified_base 125: mod_base = OTHER; note = uracil
  modified_base 129: mod_base = OTHER; note = uracil
  modified_base 133: mod_base = OTHER; note = uracil
  modified_base 135: mod_base = OTHER; note = uracil
  modified_base 143: mod_base = OTHER; note = uracil
  modified_base 152: mod_base = OTHER; note = uracil
  modified_base 153: mod_base = OTHER; note = uracil
  modified_base 163: mod_base = OTHER; note = uracil
  modified_base 167: mod_base = OTHER; note = uracil
  modified_base 169: mod_base = OTHER; note = uracil
  modified_base 173: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 182: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 200: mod_base = OTHER; note = uracil
  modified_base 203: mod_base = OTHER; note = uracil
  modified_base 207: mod_base = OTHER; note = uracil
  modified_base 211: mod_base = OTHER; note = uracil
  modified_base 221: mod_base = OTHER; note = uracil
  modified_base 226: mod_base = OTHER; note = uracil
  modified_base 233: mod_base = OTHER; note = uracil
  modified_base 241: mod_base = OTHER; note = uracil
  modified_base 244: mod_base = OTHER; note = uracil
  modified_base 245: mod_base = OTHER; note = uracil
  modified_base 249: mod_base = OTHER; note = uracil
  modified_base 250: mod_base = OTHER; note = uracil
  modified_base 264: mod_base = OTHER; note = uracil
  modified_base 266: mod_base = OTHER; note = uracil
  modified_base 267: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 299: mod_base = OTHER; note = uracil
aaatatagttagtttgttttagtttttgtttttattttttttttttttttttttgttttagttttttgttttatagtgatgggtttgggattatggggtgtttatttygggtttttttggtttgtttatttttttatgggtgttttgagygttttttttgagtyggtttaggttttttttttatatttttttttttttgtttttatttggtagtgagggttagagtttyggttagtgagttatttaaatttgggtgtggaaagtatttgggatattatttgtatttggttttttttagtt

SEQ ID NO: 498 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 13: mod_base = OTHER; note = uracil
  modified_base 14: mod_base = OTHER; note = uracil
  modified_base 20: mod_base = OTHER; note = uracil
  modified_base 30: mod_base = OTHER; note = uracil
  modified_base 31: mod_base = OTHER; note = uracil
  modified_base 32: mod_base = OTHER; note = uracil
  modified_base 38: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 70: mod_base = OTHER; note = uracil
  modified_base 76: mod_base = OTHER; note = uracil
  modified_base 78: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 102: mod_base = OTHER; note = uracil
  modified_base 129: mod_base = OTHER; note = uracil
  modified_base 130: mod_base = OTHER; note = uracil
  modified_base 135: mod_base = OTHER; note = uracil
  modified_base 139: mod_base = OTHER; note = uracil
  modified_base 141: mod_base = OTHER; note = uracil
  modified_base 152: mod_base = OTHER; note = uracil
  modified_base 154: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 177: mod_base = OTHER; note = uracil
  modified_base 181: mod_base = OTHER; note = uracil
  modified_base 182: mod_base = OTHER; note = uracil
  modified_base 190: mod_base = OTHER; note = uracil
  modified_base 191: mod_base = OTHER; note = uracil
  modified_base 201: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 206: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 223: mod_base = OTHER; note = uracil
  modified_base 225: mod_base = OTHER; note = uracil
  modified_base 233: mod_base = OTHER; note = uracil
  modified_base 240: mod_base = OTHER; note = uracil
  modified_base 246: mod_base = OTHER; note = uracil
  modified_base 273: mod_base = OTHER; note = uracil
  modified_base 279: mod_base = OTHER; note = uracil
  modified_base 285: mod_base = OTHER; note = uracil
  modified_base 289: mod_base = OTHER; note = uracil
  modified_base 293: mod_base = OTHER; note = uracil
agttaaaaggagttaaatataagtggtgttttaggtgttttttatatttaggtttggatgatttattgatygaagttttgatttttattgttagatagaagtagggaggaaagggtgtggggggaaagtttgagtyggtttaaaaaaggygtttaaagtatttatgagaaagtaagtaagttagggaagttyggaatggatattttatagttttaagtttattattgtgggataaggaattggagtaaagggaagggggaagaaaatgaggatagaggttagaatagattggttgtgttt

SEQ ID NO: 499 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 6: mod_base = OTHER; note = uracil
  modified_base 12: mod_base = OTHER; note = uracil
  modified_base 17: mod_base = OTHER; note = uracil
  modified_base 18: mod_base = OTHER; note = uracil
  modified_base 25: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 39: mod_base = OTHER; note = uracil
  modified_base 42: mod_base = OTHER; note = uracil
  modified_base 48: mod_base = OTHER; note = uracil
  modified_base 72: mod_base = OTHER; note = uracil
  modified_base 85: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 95: mod_base = OTHER; note = uracil
  modified_base 100: mod_base = OTHER; note = uracil
  modified_base 107: mod_base = OTHER; note = uracil
  modified_base 108: mod_base = OTHER; note = uracil
  modified_base 112: mod_base = OTHER; note = uracil
  modified_base 115: mod_base = OTHER; note = uracil
  modified_base 128: mod_base = OTHER; note = uracil
  modified_base 137: mod_base = OTHER; note = uracil
  modified_base 147: mod_base = OTHER; note = uracil
  modified_base 149: mod_base = OTHER; note = uracil
  modified_base 152: mod_base = OTHER; note = uracil
  modified_base 153: mod_base = OTHER; note = uracil
  modified_base 155: mod_base = OTHER; note = uracil
  modified_base 163: mod_base = OTHER; note = uracil
  modified_base 169: mod_base = OTHER; note = uracil
  modified_base 173: mod_base = OTHER; note = uracil
  modified_base 174: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 185: mod_base = OTHER; note = uracil
  modified_base 187: mod_base = OTHER; note = uracil
  modified_base 192: mod_base = OTHER; note = uracil
  modified_base 193: mod_base = OTHER; note = uracil
  modified_base 194: mod_base = OTHER; note = uracil
  modified_base 198: mod_base = OTHER; note = uracil
  modified_base 200: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 207: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 225: mod_base = OTHER; note = uracil
  modified_base 227: mod_base = OTHER; note = uracil
  modified_base 230: mod_base = OTHER; note = uracil
  modified_base 248: mod_base = OTHER; note = uracil
  modified_base 257: mod_base = OTHER; note = uracil
  modified_base 259: mod_base = OTHER; note = uracil
  modified_base 264: mod_base = OTHER; note = uracil
  modified_base 273: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 289: mod_base = OTHER; note = uracil
  modified_base 291: mod_base = OTHER; note = uracil
  modified_base 294: mod_base = OTHER; note = uracil
  modified_base 299: mod_base = OTHER; note = uracil
gtttttaaaggttgaatttttgattaatgtagtttaagttgtaygggtagagaaagggtgyggggtaggggtyggggttgggygttgagtttttttgaatyggttgttaggtaatagaatggaaatttaygggyggttaaatggagtttygttataaatgttttgtggtaaattyggatttagttatatygttttttttttttttttttattttattgagtttttttatttgtaaatgagaagggtgtagagaagattttttttttyggagttagtgttttyggtttgtattgtttttta

SEQ ID NO: 500 - DNA, 300 bp, synthetic construct
  misc_feature 1..300: note = Synthetic polynucleotide
  source 1..300: mol_type = other DNA
  modified_base 8: mod_base = OTHER; note = uracil
  modified_base 13: mod_base = OTHER; note = uracil
  modified_base 17: mod_base = OTHER; note = uracil
  modified_base 24: mod_base = OTHER; note = uracil
  modified_base 26: mod_base = OTHER; note = uracil
  modified_base 30: mod_base = OTHER; note = uracil
  modified_base 32: mod_base = OTHER; note = uracil
  modified_base 46: mod_base = OTHER; note = uracil
  modified_base 49: mod_base = OTHER; note = uracil
  modified_base 51: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 69: mod_base = OTHER; note = uracil
  modified_base 81: mod_base = OTHER; note = uracil
  modified_base 83: mod_base = OTHER; note = uracil
  modified_base 118: mod_base = OTHER; note = uracil
  modified_base 124: mod_base = OTHER; note = uracil
  modified_base 133: mod_base = OTHER; note = uracil
  modified_base 134: mod_base = OTHER; note = uracil
  modified_base 136: mod_base = OTHER; note = uracil
  modified_base 141: mod_base = OTHER; note = uracil
  modified_base 155: mod_base = OTHER; note = uracil
  modified_base 157: mod_base = OTHER; note = uracil
  modified_base 158: mod_base = OTHER; note = uracil
  modified_base 165: mod_base = OTHER; note = uracil
  modified_base 168: mod_base = OTHER; note = uracil
  modified_base 169: mod_base = OTHER; note = uracil
  modified_base 179: mod_base = OTHER; note = uracil
  modified_base 180: mod_base = OTHER; note = uracil
  modified_base 184: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 198: mod_base = OTHER; note = uracil
  modified_base 204: mod_base = OTHER; note = uracil
  modified_base 212: mod_base = OTHER; note = uracil
  modified_base 214: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 225: mod_base = OTHER; note = uracil
  modified_base 226: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 249: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 260: mod_base = OTHER; note = uracil
  modified_base 263: mod_base = OTHER; note = uracil
  modified_base 269: mod_base = OTHER; note = uracil
  modified_base 272: mod_base = OTHER; note = uracil
  modified_base 279: mod_base = OTHER; note = uracil
  modified_base 287: mod_base = OTHER; note = uracil
  modified_base 290: mod_base = OTHER; note = uracil
  modified_base 291: mod_base = OTHER; note = uracil
  modified_base 300: mod_base = OTHER; note = uracil
tgaaaagtagtgtaaatyggaggtattgatttygaagaaaagagttttttttgtattttttttatttatagatgagaaaatttagtggggtgggaggggggagaaagggygatgtgattgggttygggtttgttatagaatatttgtggyggagttttatttagtygttygtgaatttttattttgttgtttggtaatyggtttagaggagtttagygtttaatttyggtttttatttygtattttttttttgttygtgtagtttgggttgtattgattaaaggtttagtttttggggat

SEQ ID NO: 501 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 4: mod_base = OTHER; note = uracil
  modified_base 6: mod_base = OTHER; note = uracil
  modified_base 9: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 21: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 44: mod_base = OTHER; note = uracil
  modified_base 45: mod_base = OTHER; note = uracil
  modified_base 50: mod_base = OTHER; note = uracil
  modified_base 54: mod_base = OTHER; note = uracil
  modified_base 74: mod_base = OTHER; note = uracil
  modified_base 84: mod_base = OTHER; note = uracil
  modified_base 91: mod_base = OTHER; note = uracil
  modified_base 93: mod_base = OTHER; note = uracil
  modified_base 96: mod_base = OTHER; note = uracil
  modified_base 104: mod_base = OTHER; note = uracil
  modified_base 106: mod_base = OTHER; note = uracil
  modified_base 114: mod_base = OTHER; note = uracil
  modified_base 119: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 129: mod_base = OTHER; note = uracil
  modified_base 132: mod_base = OTHER; note = uracil
  modified_base 134: mod_base = OTHER; note = uracil
  modified_base 150: mod_base = OTHER; note = uracil
  modified_base 153: mod_base = OTHER; note = uracil
  modified_base 154: mod_base = OTHER; note = uracil
  modified_base 162: mod_base = OTHER; note = uracil
  modified_base 180: mod_base = OTHER; note = uracil
  modified_base 181: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 197: mod_base = OTHER; note = uracil
  modified_base 201: mod_base = OTHER; note = uracil
  modified_base 202: mod_base = OTHER; note = uracil
  modified_base 205: mod_base = OTHER; note = uracil
  modified_base 214: mod_base = OTHER; note = uracil
  modified_base 217: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 234: mod_base = OTHER; note = uracil
  modified_base 235: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 255: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 271: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 282: mod_base = OTHER; note = uracil
  modified_base 289: mod_base = OTHER; note = uracil
  modified_base 292: mod_base = OTHER; note = uracil
  modified_base 297: mod_base = OTHER; note = uracil
ttttatygtyggttygttttttgaggagggggttgggttagggtttyggttgatyggggaggaagaaggggagtagagaaaaatatgagttatagtygtgtgttattggagygtattttaattttttgtattataggaggtgtggaaggtygtttyggggatygggygygggaggtgygttygagaaggtttygggtyggtttgtagggygygtygtttygtttgygttttttttttttttatygtttttttygttatttttttttttggtttttttttygttyggtgtaataagttttt

SEQ ID NO: 502 - DNA, 301 bp, synthetic construct
  misc_feature 1..301: note = Synthetic polynucleotide
  source 1..301: mol_type = other DNA
  modified_base 6: mod_base = OTHER; note = uracil
  modified_base 13: mod_base = OTHER; note = uracil
  modified_base 15: mod_base = OTHER; note = uracil
  modified_base 31: mod_base = OTHER; note = uracil
  modified_base 32: mod_base = OTHER; note = uracil
  modified_base 76: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 97: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 124: mod_base = OTHER; note = uracil
  modified_base 126: mod_base = OTHER; note = uracil
  modified_base 127: mod_base = OTHER; note = uracil
  modified_base 129: mod_base = OTHER; note = uracil
  modified_base 130: mod_base = OTHER; note = uracil
  modified_base 135: mod_base = OTHER; note = uracil
  modified_base 136: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 153: mod_base = OTHER; note = uracil
  modified_base 154: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 174: mod_base = OTHER; note = uracil
  modified_base 191: mod_base = OTHER; note = uracil
  modified_base 193: mod_base = OTHER; note = uracil
  modified_base 194: mod_base = OTHER; note = uracil
  modified_base 200: mod_base = OTHER; note = uracil
  modified_base 202: mod_base = OTHER; note = uracil
  modified_base 207: mod_base = OTHER; note = uracil
  modified_base 213: mod_base = OTHER; note = uracil
  modified_base 215: mod_base = OTHER; note = uracil
  modified_base 224: mod_base = OTHER; note = uracil
  modified_base 226: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 250: mod_base = OTHER; note = uracil
  modified_base 253: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 273: mod_base = OTHER; note = uracil
  modified_base 274: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 290: mod_base = OTHER; note = uracil
aaagatttgttgtatygagygagaaggaagttaaaggggaagatggyggggagggyggtgggggaggaaagggygtaggyggagyggygygttttgtaggtyggttyggggttttttygggygtatttttygygttyggttttygaggyyggttttttatattttttgtgatgtagggaattgaaatgygttttagtgatatayggttgtgatttatgtttttttttgtttttttttttttttttyggttagtygaggttttggtttagttttttttttagggggygagtyggyggtggag

SEQ ID NO: 503 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 10: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 25: mod_base = OTHER; note = uracil
  modified_base 27: mod_base = OTHER; note = uracil
  modified_base 37: mod_base = OTHER; note = uracil
  modified_base 38: mod_base = OTHER; note = uracil
  modified_base 43: mod_base = OTHER; note = uracil
  modified_base 48: mod_base = OTHER; note = uracil
  modified_base 50: mod_base = OTHER; note = uracil
  modified_base 71: mod_base = OTHER; note = uracil
  modified_base 75: mod_base = OTHER; note = uracil
  modified_base 77: mod_base = OTHER; note = uracil
  modified_base 78: mod_base = OTHER; note = uracil
  modified_base 79: mod_base = OTHER; note = uracil
  modified_base 83: mod_base = OTHER; note = uracil
  modified_base 88: mod_base = OTHER; note = uracil
  modified_base 91: mod_base = OTHER; note = uracil
  modified_base 101: mod_base = OTHER; note = uracil
  modified_base 105: mod_base = OTHER; note = uracil
  modified_base 107: mod_base = OTHER; note = uracil
  modified_base 108: mod_base = OTHER; note = uracil
  modified_base 111: mod_base = OTHER; note = uracil
  modified_base 115: mod_base = OTHER; note = uracil
  modified_base 123: mod_base = OTHER; note = uracil
  modified_base 124: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 144: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 164: mod_base = OTHER; note = uracil
  modified_base 165: mod_base = OTHER; note = uracil
  modified_base 170: mod_base = OTHER; note = uracil
  modified_base 171: mod_base = OTHER; note = uracil
  modified_base 172: mod_base = OTHER; note = uracil
  modified_base 176: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 186: mod_base = OTHER; note = uracil
  modified_base 187: mod_base = OTHER; note = uracil
  modified_base 192: mod_base = OTHER; note = uracil
  modified_base 198: mod_base = OTHER; note = uracil
  modified_base 200: mod_base = OTHER; note = uracil
  modified_base 202: mod_base = OTHER; note = uracil
  modified_base 203: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 219: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 228: mod_base = OTHER; note = uracil
  modified_base 229: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 239: mod_base = OTHER; note = uracil
  modified_base 241: mod_base = OTHER; note = uracil
  modified_base 245: mod_base = OTHER; note = uracil
  modified_base 246: mod_base = OTHER; note = uracil
  modified_base 247: mod_base = OTHER; note = uracil
  modified_base 250: mod_base = OTHER; note = uracil
  modified_base 253: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 267: mod_base = OTHER; note = uracil
  modified_base 268: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 275: mod_base = OTHER; note = uracil
  modified_base 277: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 292: mod_base = OTHER; note = uracil
  modified_base 295: mod_base = OTHER; note = uracil
  modified_base 297: mod_base = OTHER; note = uracil
tttgaagagtattttttttgagtgtttaatgatatgttagagtatgttttaaatgyggaggatggggaggtyggttttttggtagatttttatggagaagttgattttagtyggtttgtgtgttygttttagaggagyggaaatagagtygaagtttatatttttagggtttaggtttagtttttttaagttyggagtttatttagtttgtttttyggtttttttatttttttttagatatygtttttttttttgtttttgtattttttatttttttygtttttttttgtgttgttttgt

SEQ ID NO: 504 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 7: mod_base = OTHER; note = uracil
  modified_base 10: mod_base = OTHER; note = uracil
  modified_base 12: mod_base = OTHER; note = uracil
  modified_base 40: mod_base = OTHER; note = uracil
  modified_base 46: mod_base = OTHER; note = uracil
  modified_base 64: mod_base = OTHER; note = uracil
  modified_base 83: mod_base = OTHER; note = uracil
  modified_base 91: mod_base = OTHER; note = uracil
  modified_base 95: mod_base = OTHER; note = uracil
  modified_base 104: mod_base = OTHER; note = uracil
  modified_base 106: mod_base = OTHER; note = uracil
  modified_base 111: mod_base = OTHER; note = uracil
  modified_base 121: mod_base = OTHER; note = uracil
  modified_base 126: mod_base = OTHER; note = uracil
  modified_base 127: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 147: mod_base = OTHER; note = uracil
  modified_base 153: mod_base = OTHER; note = uracil
  modified_base 155: mod_base = OTHER; note = uracil
  modified_base 161: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 179: mod_base = OTHER; note = uracil
  modified_base 181: mod_base = OTHER; note = uracil
  modified_base 183: mod_base = OTHER; note = uracil
  modified_base 187: mod_base = OTHER; note = uracil
  modified_base 191: mod_base = OTHER; note = uracil
  modified_base 198: mod_base = OTHER; note = uracil
  modified_base 201: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 227: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 255: mod_base = OTHER; note = uracil
  modified_base 259: mod_base = OTHER; note = uracil
  modified_base 261: mod_base = OTHER; note = uracil
  modified_base 265: mod_base = OTHER; note = uracil
  modified_base 270: mod_base = OTHER; note = uracil
  modified_base 277: mod_base = OTHER; note = uracil
  modified_base 279: mod_base = OTHER; note = uracil
  modified_base 281: mod_base = OTHER; note = uracil
  modified_base 292: mod_base = OTHER; note = uracil
  modified_base 294: mod_base = OTHER; note = uracil
  modified_base 297: mod_base = OTHER; note = uracil
atagagtagtatagggaggggyggagaggatgggaaatgtagagatagaagaagggayggtgtttggaggaggatgaaggagtygaggggtaggttgggtgagtttyggatttggaagggttgggtttgggttttgggggtgtgggtttyggttttgttttygtttttttgggaygggtatataagtyggttggagttagtttttttatgaagatttgttagggagtyggtttttttatttttygtatttgagatatgttttggtatattattgagtatttagggagaatgttttttagg

SEQ ID NO: 505 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 13: mod_base = OTHER; note = uracil
  modified_base 14: mod_base = OTHER; note = uracil
  modified_base 20: mod_base = OTHER; note = uracil
  modified_base 23: mod_base = OTHER; note = uracil
  modified_base 25: mod_base = OTHER; note = uracil
  modified_base 27: mod_base = OTHER; note = uracil
  modified_base 31: mod_base = OTHER; note = uracil
  modified_base 35: mod_base = OTHER; note = uracil
  modified_base 37: mod_base = OTHER; note = uracil
  modified_base 40: mod_base = OTHER; note = uracil
  modified_base 45: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 56: mod_base = OTHER; note = uracil
  modified_base 57: mod_base = OTHER; note = uracil
  modified_base 64: mod_base = OTHER; note = uracil
  modified_base 65: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 91: mod_base = OTHER; note = uracil
  modified_base 109: mod_base = OTHER; note = uracil
  modified_base 122: mod_base = OTHER; note = uracil
  modified_base 127: mod_base = OTHER; note = uracil
  modified_base 137: mod_base = OTHER; note = uracil
  modified_base 138: mod_base = OTHER; note = uracil
  modified_base 142: mod_base = OTHER; note = uracil
  modified_base 143: mod_base = OTHER; note = uracil
  modified_base 149: mod_base = OTHER; note = uracil
  modified_base 153: mod_base = OTHER; note = uracil
  modified_base 159: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 190: mod_base = OTHER; note = uracil
  modified_base 197: mod_base = OTHER; note = uracil
  modified_base 201: mod_base = OTHER; note = uracil
  modified_base 206: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 222: mod_base = OTHER; note = uracil
  modified_base 223: mod_base = OTHER; note = uracil
  modified_base 229: mod_base = OTHER; note = uracil
  modified_base 231: mod_base = OTHER; note = uracil
  modified_base 233: mod_base = OTHER; note = uracil
  modified_base 236: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 246: mod_base = OTHER; note = uracil
  modified_base 248: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 257: mod_base = OTHER; note = uracil
  modified_base 258: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 270: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 284: mod_base = OTHER; note = uracil
  modified_base 290: mod_base = OTHER; note = uracil
  modified_base 293: mod_base = OTHER; note = uracil
  modified_base 295: mod_base = OTHER; note = uracil
  modified_base 296: mod_base = OTHER; note = uracil
  modified_base 298: mod_base = OTHER; note = uracil
  modified_base 300: mod_base = OTHER; note = uracil
atgtttgggaggttaaaagtattttttagatagtttttataggatttttttaggtttyggaagttygagygagttttttggaggaggtggttggggagagtggaggagtyggtaggggtygttgtgtttgygygygttygtttaggaattygtyggggttgtggggagggggygtyggtttggagaggataatgtatagtttgttttaatatttatttattttaaaygtatattttttatttygttttttgttttttttagtttyggggttagattttgagggttygggtygtattttat

SEQ ID NO: 506 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 13: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 22: mod_base = OTHER; note = uracil
  modified_base 28: mod_base = OTHER; note = uracil
  modified_base 32: mod_base = OTHER; note = uracil
  modified_base 33: mod_base = OTHER; note = uracil
  modified_base 34: mod_base = OTHER; note = uracil
  modified_base 40: mod_base = OTHER; note = uracil
  modified_base 50: mod_base = OTHER; note = uracil
  modified_base 98: mod_base = OTHER; note = uracil
  modified_base 102: mod_base = OTHER; note = uracil
  modified_base 107: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 123: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 155: mod_base = OTHER; note = uracil
  modified_base 156: mod_base = OTHER; note = uracil
  modified_base 171: mod_base = OTHER; note = uracil
  modified_base 175: mod_base = OTHER; note = uracil
  modified_base 177: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 189: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 203: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 218: mod_base = OTHER; note = uracil
  modified_base 220: mod_base = OTHER; note = uracil
  modified_base 221: mod_base = OTHER; note = uracil
  modified_base 228: mod_base = OTHER; note = uracil
  modified_base 232: mod_base = OTHER; note = uracil
  modified_base 238: mod_base = OTHER; note = uracil
  modified_base 241: mod_base = OTHER; note = uracil
  modified_base 247: mod_base = OTHER; note = uracil
  modified_base 248: mod_base = OTHER; note = uracil
  modified_base 258: mod_base = OTHER; note = uracil
  modified_base 259: mod_base = OTHER; note = uracil
  modified_base 268: mod_base = OTHER; note = uracil
  modified_base 272: mod_base = OTHER; note = uracil
  modified_base 282: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 298: mod_base = OTHER; note = uracil
gtgaggtgyggttygagtttttagggtttagtttyggggttgggagggataagagayggggtgggaagtgtgygtttggagtgggtgggtgttagaatagattgtatattgttttttttaggtyggygttttttttttatagtttyggygagtttttggaygggygygygtaagtatagygatttttatyggtttttttattttttttagttattttttttaggaagttygttygggttttygggatttggaagagttttgtagagattgtttgagagatgtttttggttttttagatat

SEQ ID NO: 507 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 15: mod_base = OTHER; note = uracil
  modified_base 36: mod_base = OTHER; note = uracil
  modified_base 72: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 96: mod_base = OTHER; note = uracil
  modified_base 99: mod_base = OTHER; note = uracil
  modified_base 102: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 125: mod_base = OTHER; note = uracil
  modified_base 134: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 146: mod_base = OTHER; note = uracil
  modified_base 158: mod_base = OTHER; note = uracil
  modified_base 172: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 182: mod_base = OTHER; note = uracil
  modified_base 189: mod_base = OTHER; note = uracil
  modified_base 190: mod_base = OTHER; note = uracil
  modified_base 209: mod_base = OTHER; note = uracil
  modified_base 211: mod_base = OTHER; note = uracil
  modified_base 215: mod_base = OTHER; note = uracil
  modified_base 222: mod_base = OTHER; note = uracil
  modified_base 223: mod_base = OTHER; note = uracil
  modified_base 232: mod_base = OTHER; note = uracil
  modified_base 234: mod_base = OTHER; note = uracil
  modified_base 244: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 262: mod_base = OTHER; note = uracil
  modified_base 263: mod_base = OTHER; note = uracil
  modified_base 267: mod_base = OTHER; note = uracil
  modified_base 269: mod_base = OTHER; note = uracil
  modified_base 272: mod_base = OTHER; note = uracil
  modified_base 273: mod_base = OTHER; note = uracil
  modified_base 276: mod_base = OTHER; note = uracil
  modified_base 282: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 298: mod_base = OTHER; note = uracil
ggagygttaaygygtagtgggagggaaggagaggattgaagagagaygggggaggggagaggaggggtyggttgttaggtttaggtggggtgaattygtagttgggttgatttaagyggaggagtyggaaggatatttygygaggtttyggggygygtttttagggaggygtygtttttagttttgtgttagaaagtgggggttgyggtttaggtttgaatttaagaaaggtttygggtggaatttttgggtattttgggtttttattttgtttttaggygttggttatygttgggattt

SEQ ID NO: 508 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 5: mod_base = OTHER; note = uracil
  modified_base 6: mod_base = OTHER; note = uracil
  modified_base 15: mod_base = OTHER; note = uracil
  modified_base 16: mod_base = OTHER; note = uracil
  modified_base 21: mod_base = OTHER; note = uracil
  modified_base 22: mod_base = OTHER; note = uracil
  modified_base 29: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 49: mod_base = OTHER; note = uracil
  modified_base 50: mod_base = OTHER; note = uracil
  modified_base 51: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 82: mod_base = OTHER; note = uracil
  modified_base 86: mod_base = OTHER; note = uracil
  modified_base 87: mod_base = OTHER; note = uracil
  modified_base 92: mod_base = OTHER; note = uracil
  modified_base 95: mod_base = OTHER; note = uracil
  modified_base 98: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 108: mod_base = OTHER; note = uracil
  modified_base 112: mod_base = OTHER; note = uracil
  modified_base 114: mod_base = OTHER; note = uracil
  modified_base 119: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 156: mod_base = OTHER; note = uracil
  modified_base 168: mod_base = OTHER; note = uracil
  modified_base 169: mod_base = OTHER; note = uracil
  modified_base 172: mod_base = OTHER; note = uracil
  modified_base 176: mod_base = OTHER; note = uracil
  modified_base 178: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 191: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 199: mod_base = OTHER; note = uracil
  modified_base 208: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 213: mod_base = OTHER; note = uracil
  modified_base 215: mod_base = OTHER; note = uracil
  modified_base 216: mod_base = OTHER; note = uracil
  modified_base 221: mod_base = OTHER; note = uracil
  modified_base 222: mod_base = OTHER; note = uracil
  modified_base 226: mod_base = OTHER; note = uracil
  modified_base 229: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 241: mod_base = OTHER; note = uracil
  modified_base 243: mod_base = OTHER; note = uracil
  modified_base 244: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 251: mod_base = OTHER; note = uracil
  modified_base 255: mod_base = OTHER; note = uracil
  modified_base 257: mod_base = OTHER; note = uracil
  modified_base 259: mod_base = OTHER; note = uracil
  modified_base 262: mod_base = OTHER; note = uracil
  modified_base 266: mod_base = OTHER; note = uracil
  modified_base 267: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 283: mod_base = OTHER; note = uracil
  modified_base 296: mod_base = OTHER; note = uracil
  modified_base 298: mod_base = OTHER; note = uracil
  modified_base 299: mod_base = OTHER; note = uracil
  modified_base 300: mod_base = OTHER; note = uracil
agttttaayggtggttagygtttgaaggtagagtaaggatttagggtgtttaggagttttattyggagttttttttggatttaagtttgagtygtaatttttattttttggtataaagttggaggyggygtttttttaaaagygygtttygaagtttygyggggtgttttttyggttttttygtttgagttagtttagttgyggatttattttatttaggtttggtagtygatttttttttttttttttttygtttttttttagtttttttttttttttttattgygygttagygttttt

SEQ ID NO: 509 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 10: mod_base = OTHER; note = uracil
  modified_base 11: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 34: mod_base = OTHER; note = uracil
  modified_base 38: mod_base = OTHER; note = uracil
  modified_base 43: mod_base = OTHER; note = uracil
  modified_base 44: mod_base = OTHER; note = uracil
  modified_base 46: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 56: mod_base = OTHER; note = uracil
  modified_base 57: mod_base = OTHER; note = uracil
  modified_base 65: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 78: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 92: mod_base = OTHER; note = uracil
  modified_base 95: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 105: mod_base = OTHER; note = uracil
  modified_base 106: mod_base = OTHER; note = uracil
  modified_base 118: mod_base = OTHER; note = uracil
  modified_base 126: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 148: mod_base = OTHER; note = uracil
  modified_base 152: mod_base = OTHER; note = uracil
  modified_base 153: mod_base = OTHER; note = uracil
  modified_base 157: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 170: mod_base = OTHER; note = uracil
  modified_base 177: mod_base = OTHER; note = uracil
  modified_base 178: mod_base = OTHER; note = uracil
  modified_base 183: mod_base = OTHER; note = uracil
  modified_base 191: mod_base = OTHER; note = uracil
  modified_base 194: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 210: mod_base = OTHER; note = uracil
  modified_base 216: mod_base = OTHER; note = uracil
  modified_base 217: mod_base = OTHER; note = uracil
  modified_base 218: mod_base = OTHER; note = uracil
  modified_base 227: mod_base = OTHER; note = uracil
  modified_base 233: mod_base = OTHER; note = uracil
  modified_base 236: mod_base = OTHER; note = uracil
  modified_base 237: mod_base = OTHER; note = uracil
  modified_base 239: mod_base = OTHER; note = uracil
  modified_base 240: mod_base = OTHER; note = uracil
  modified_base 244: mod_base = OTHER; note = uracil
  modified_base 257: mod_base = OTHER; note = uracil
  modified_base 264: mod_base = OTHER; note = uracil
  modified_base 269: mod_base = OTHER; note = uracil
  modified_base 270: mod_base = OTHER; note = uracil
  modified_base 275: mod_base = OTHER; note = uracil
  modified_base 278: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 286: mod_base = OTHER; note = uracil
  modified_base 289: mod_base = OTHER; note = uracil
  modified_base 291: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 296: mod_base = OTHER; note = uracil
tattagaatttatatatttaggtgggtttaggattttttaggttttttttttaggttataggagtatttatttygggtttttttggaggggtagttttaaggaatttgttggggtaatttgtttgttttttatatttygggaatgtgtygtttttttaggttygtttattyggatttttgtgtagggagttagtygatatagtatgttgtatgtgttttgtggggataygttttgttttttgttagggggaggaggttggyggtygtgtttgtgttgtygtattttagttttttatygaa

SEQ ID NO: 510 - DNA, 300 bp, synthetic construct
  misc_feature 1..300: note = Synthetic polynucleotide
  source 1..300: mol_type = other DNA
  modified_base 12: mod_base = OTHER; note = uracil
  modified_base 23: mod_base = OTHER; note = uracil
  modified_base 26: mod_base = OTHER; note = uracil
  modified_base 28: mod_base = OTHER; note = uracil
  modified_base 32: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 48: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 54: mod_base = OTHER; note = uracil
  modified_base 58: mod_base = OTHER; note = uracil
  modified_base 65: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 78: mod_base = OTHER; note = uracil
  modified_base 80: mod_base = OTHER; note = uracil
  modified_base 85: mod_base = OTHER; note = uracil
  modified_base 87: mod_base = OTHER; note = uracil
  modified_base 91: mod_base = OTHER; note = uracil
  modified_base 94: mod_base = OTHER; note = uracil
  modified_base 98: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 115: mod_base = OTHER; note = uracil
  modified_base 118: mod_base = OTHER; note = uracil
  modified_base 120: mod_base = OTHER; note = uracil
  modified_base 127: mod_base = OTHER; note = uracil
  modified_base 140: mod_base = OTHER; note = uracil
  modified_base 141: mod_base = OTHER; note = uracil
  modified_base 153: mod_base = OTHER; note = uracil
  modified_base 155: mod_base = OTHER; note = uracil
  modified_base 159: mod_base = OTHER; note = uracil
  modified_base 160: mod_base = OTHER; note = uracil
  modified_base 175: mod_base = OTHER; note = uracil
  modified_base 179: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 189: mod_base = OTHER; note = uracil
  modified_base 192: mod_base = OTHER; note = uracil
  modified_base 198: mod_base = OTHER; note = uracil
  modified_base 199: mod_base = OTHER; note = uracil
  modified_base 206: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 212: mod_base = OTHER; note = uracil
  modified_base 214: mod_base = OTHER; note = uracil
  modified_base 215: mod_base = OTHER; note = uracil
  modified_base 223: mod_base = OTHER; note = uracil
  modified_base 224: mod_base = OTHER; note = uracil
  modified_base 236: mod_base = OTHER; note = uracil
  modified_base 238: mod_base = OTHER; note = uracil
  modified_base 239: mod_base = OTHER; note = uracil
  modified_base 245: mod_base = OTHER; note = uracil
  modified_base 246: mod_base = OTHER; note = uracil
  modified_base 258: mod_base = OTHER; note = uracil
  modified_base 259: mod_base = OTHER; note = uracil
  modified_base 268: mod_base = OTHER; note = uracil
  modified_base 269: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 279: mod_base = OTHER; note = uracil
  modified_base 294: mod_base = OTHER; note = uracil
  modified_base 300: mod_base = OTHER; note = uracil
tyggtggggagttgaggtgyggtagtataggtayggtygttagttttttttttttgataggaggtagaaygtgtttttatagggtatatgtaatatgttgtgtyggttgattttttgtataggaattygggtgggygggtttgaaaggayggtatattttyggggtgtggggagtaaataagttattttaataggttttttggggttgtttttttagaggagttyggggtgggtgtttttatggtttgagggagaggtttagaaagttttaaatttatttgggtatgtggattttgatat

SEQ ID NO: 511 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 16: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 25: mod_base = OTHER; note = uracil
  modified_base 29: mod_base = OTHER; note = uracil
  modified_base 31: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 51: mod_base = OTHER; note = uracil
  modified_base 57: mod_base = OTHER; note = uracil
  modified_base 61: mod_base = OTHER; note = uracil
  modified_base 64: mod_base = OTHER; note = uracil
  modified_base 65: mod_base = OTHER; note = uracil
  modified_base 67: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 89: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 102: mod_base = OTHER; note = uracil
  modified_base 104: mod_base = OTHER; note = uracil
  modified_base 116: mod_base = OTHER; note = uracil
  modified_base 120: mod_base = OTHER; note = uracil
  modified_base 132: mod_base = OTHER; note = uracil
  modified_base 136: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 163: mod_base = OTHER; note = uracil
  modified_base 165: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 193: mod_base = OTHER; note = uracil
  modified_base 199: mod_base = OTHER; note = uracil
  modified_base 205: mod_base = OTHER; note = uracil
  modified_base 208: mod_base = OTHER; note = uracil
  modified_base 220: mod_base = OTHER; note = uracil
  modified_base 228: mod_base = OTHER; note = uracil
  modified_base 231: mod_base = OTHER; note = uracil
  modified_base 232: mod_base = OTHER; note = uracil
  modified_base 244: mod_base = OTHER; note = uracil
  modified_base 246: mod_base = OTHER; note = uracil
  modified_base 251: mod_base = OTHER; note = uracil
  modified_base 254: mod_base = OTHER; note = uracil
  modified_base 256: mod_base = OTHER; note = uracil
  modified_base 260: mod_base = OTHER; note = uracil
  modified_base 262: mod_base = OTHER; note = uracil
  modified_base 267: mod_base = OTHER; note = uracil
  modified_base 275: mod_base = OTHER; note = uracil
  modified_base 288: mod_base = OTHER; note = uracil
  modified_base 289: mod_base = OTHER; note = uracil
  modified_base 297: mod_base = OTHER; note = uracil
  modified_base 298: mod_base = OTHER; note = uracil
  modified_base 299: mod_base = OTHER; note = uracil
agaggatttaagatttatttagggtaaatattgggattattgtaagagygttggaatattttgttttttgagtgaaggggttttttttttagtttttatggtattgaggggtgygtyggttggtggaggagtagttygatggagttttgygtttttyggggatatagggttaagttttgaggtggaaagtttttggttttgaaataataaggagagagtttgtttttttttttaaaatttggatttttgtttgtataaattttggtttgttttgtayggtttgtgtgttttttttttttt

SEQ ID NO: 512 - DNA, 300 bp, synthetic construct
  misc_feature 1..300: note = Synthetic polynucleotide
  source 1..300: mol_type = other DNA
  modified_base 13: mod_base = OTHER; note = uracil
  modified_base 15: mod_base = OTHER; note = uracil
  modified_base 17: mod_base = OTHER; note = uracil
  modified_base 21: mod_base = OTHER; note = uracil
  modified_base 26: mod_base = OTHER; note = uracil
  modified_base 31: mod_base = OTHER; note = uracil
  modified_base 35: mod_base = OTHER; note = uracil
  modified_base 36: mod_base = OTHER; note = uracil
  modified_base 47: mod_base = OTHER; note = uracil
  modified_base 51: mod_base = OTHER; note = uracil
  modified_base 58: mod_base = OTHER; note = uracil
  modified_base 59: mod_base = OTHER; note = uracil
  modified_base 78: mod_base = OTHER; note = uracil
  modified_base 82: mod_base = OTHER; note = uracil
  modified_base 84: mod_base = OTHER; note = uracil
  modified_base 86: mod_base = OTHER; note = uracil
  modified_base 88: mod_base = OTHER; note = uracil
  modified_base 89: mod_base = OTHER; note = uracil
  modified_base 99: mod_base = OTHER; note = uracil
  modified_base 104: mod_base = OTHER; note = uracil
  modified_base 105: mod_base = OTHER; note = uracil
  modified_base 111: mod_base = OTHER; note = uracil
  modified_base 115: mod_base = OTHER; note = uracil
  modified_base 116: mod_base = OTHER; note = uracil
  modified_base 118: mod_base = OTHER; note = uracil
  modified_base 119: mod_base = OTHER; note = uracil
  modified_base 121: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 133: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 151: mod_base = OTHER; note = uracil
  modified_base 156: mod_base = OTHER; note = uracil
  modified_base 158: mod_base = OTHER; note = uracil
  modified_base 159: mod_base = OTHER; note = uracil
  modified_base 166: mod_base = OTHER; note = uracil
  modified_base 169: mod_base = OTHER; note = uracil
  modified_base 171: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 194: mod_base = OTHER; note = uracil
  modified_base 199: mod_base = OTHER; note = uracil
  modified_base 200: mod_base = OTHER; note = uracil
  modified_base 208: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 226: mod_base = OTHER; note = uracil
  modified_base 228: mod_base = OTHER; note = uracil
  modified_base 230: mod_base = OTHER; note = uracil
  modified_base 237: mod_base = OTHER; note = uracil
  modified_base 246: mod_base = OTHER; note = uracil
  modified_base 247: mod_base = OTHER; note = uracil
  modified_base 252: mod_base = OTHER; note = uracil
  modified_base 254: mod_base = OTHER; note = uracil
  modified_base 258: mod_base = OTHER; note = uracil
  modified_base 265: mod_base = OTHER; note = uracil
  modified_base 266: mod_base = OTHER; note = uracil
  modified_base 267: mod_base = OTHER; note = uracil
  modified_base 276: mod_base = OTHER; note = uracil
  modified_base 277: mod_base = OTHER; note = uracil
  modified_base 278: mod_base = OTHER; note = uracil
  modified_base 288: mod_base = OTHER; note = uracil
  modified_base 295: mod_base = OTHER; note = uracil
  modified_base 296: mod_base = OTHER; note = uracil
  modified_base 298: mod_base = OTHER; note = uracil
gggaaaaaaaggtatataaatygtgtaaaatagattagagtttgtgtagataagagtttaaattttaggaagaaaaatagattttttttttgttgttttagaattagaaattttttattttaaagtttggttttgtgttttyggggaaygtagggttttatyggattgtttttttattagtyggygtattttttagtgttatagaggttagaaagaaggtttttttatttaagaggtagaatgttttagygtttttatagtggttttagtgtttgttttgggtgagttttaaattttttt

SEQ ID NO: 513 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 6: mod_base = OTHER; note = uracil
  modified_base 12: mod_base = OTHER; note = uracil
  modified_base 21: mod_base = OTHER; note = uracil
  modified_base 27: mod_base = OTHER; note = uracil
  modified_base 28: mod_base = OTHER; note = uracil
  modified_base 35: mod_base = OTHER; note = uracil
  modified_base 37: mod_base = OTHER; note = uracil
  modified_base 42: mod_base = OTHER; note = uracil
  modified_base 43: mod_base = OTHER; note = uracil
  modified_base 50: mod_base = OTHER; note = uracil
  modified_base 56: mod_base = OTHER; note = uracil
  modified_base 61: mod_base = OTHER; note = uracil
  modified_base 62: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 71: mod_base = OTHER; note = uracil
  modified_base 72: mod_base = OTHER; note = uracil
  modified_base 83: mod_base = OTHER; note = uracil
  modified_base 84: mod_base = OTHER; note = uracil
  modified_base 89: mod_base = OTHER; note = uracil
  modified_base 96: mod_base = OTHER; note = uracil
  modified_base 100: mod_base = OTHER; note = uracil
  modified_base 102: mod_base = OTHER; note = uracil
  modified_base 104: mod_base = OTHER; note = uracil
  modified_base 107: mod_base = OTHER; note = uracil
  modified_base 110: mod_base = OTHER; note = uracil
  modified_base 126: mod_base = OTHER; note = uracil
  modified_base 130: mod_base = OTHER; note = uracil
  modified_base 137: mod_base = OTHER; note = uracil
  modified_base 142: mod_base = OTHER; note = uracil
  modified_base 148: mod_base = OTHER; note = uracil
  modified_base 154: mod_base = OTHER; note = uracil
  modified_base 155: mod_base = OTHER; note = uracil
  modified_base 156: mod_base = OTHER; note = uracil
  modified_base 164: mod_base = OTHER; note = uracil
  modified_base 165: mod_base = OTHER; note = uracil
  modified_base 167: mod_base = OTHER; note = uracil
  modified_base 172: mod_base = OTHER; note = uracil
  modified_base 178: mod_base = OTHER; note = uracil
  modified_base 179: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 193: mod_base = OTHER; note = uracil
  modified_base 196: mod_base = OTHER; note = uracil
  modified_base 198: mod_base = OTHER; note = uracil
  modified_base 204: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 225: mod_base = OTHER; note = uracil
  modified_base 230: mod_base = OTHER; note = uracil
  modified_base 246: mod_base = OTHER; note = uracil
  modified_base 247: mod_base = OTHER; note = uracil
  modified_base 251: mod_base = OTHER; note = uracil
  modified_base 252: mod_base = OTHER; note = uracil
  modified_base 257: mod_base = OTHER; note = uracil
  modified_base 258: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 272: mod_base = OTHER; note = uracil
  modified_base 277: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 293: mod_base = OTHER; note = uracil
  modified_base 296: mod_base = OTHER; note = uracil
  modified_base 298: mod_base = OTHER; note = uracil
  modified_base 299: mod_base = OTHER; note = uracil
tgtttttgagtttaaaayggtagtggtttaggagtatagggtttgggggtaggggtagtgttatatttaatttgagatatgtttagagttgaggtttagtttatagtatttgtgygtyggggaagttggttgyggttayggtyggtgtagyggtttaaggagtttataaagtagtaattttggtttatattatagtttyggtgtatttggagagggggtttagtttaggttgaagttggggggagtttggttagggtttgggtattaggygtaggatagagggaaaggtttttagttttt

SEQ ID NO: 514 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 22: mod_base = OTHER; note = uracil
  modified_base 26: mod_base = OTHER; note = uracil
  modified_base 27: mod_base = OTHER; note = uracil
  modified_base 32: mod_base = OTHER; note = uracil
  modified_base 33: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 45: mod_base = OTHER; note = uracil
  modified_base 46: mod_base = OTHER; note = uracil
  modified_base 47: mod_base = OTHER; note = uracil
  modified_base 51: mod_base = OTHER; note = uracil
  modified_base 52: mod_base = OTHER; note = uracil
  modified_base 56: mod_base = OTHER; note = uracil
  modified_base 58: mod_base = OTHER; note = uracil
  modified_base 59: mod_base = OTHER; note = uracil
  modified_base 60: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 66: mod_base = OTHER; note = uracil
  modified_base 69: mod_base = OTHER; note = uracil
  modified_base 72: mod_base = OTHER; note = uracil
  modified_base 73: mod_base = OTHER; note = uracil
  modified_base 78: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 98: mod_base = OTHER; note = uracil
  modified_base 100: mod_base = OTHER; note = uracil
  modified_base 106: mod_base = OTHER; note = uracil
  modified_base 118: mod_base = OTHER; note = uracil
  modified_base 119: mod_base = OTHER; note = uracil
  modified_base 127: mod_base = OTHER; note = uracil
  modified_base 130: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 148: mod_base = OTHER; note = uracil
  modified_base 151: mod_base = OTHER; note = uracil
  modified_base 154: mod_base = OTHER; note = uracil
  modified_base 156: mod_base = OTHER; note = uracil
  modified_base 160: mod_base = OTHER; note = uracil
  modified_base 166: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 176: mod_base = OTHER; note = uracil
  modified_base 179: mod_base = OTHER; note = uracil
  modified_base 180: mod_base = OTHER; note = uracil
  modified_base 181: mod_base = OTHER; note = uracil
  modified_base 187: mod_base = OTHER; note = uracil
  modified_base 189: mod_base = OTHER; note = uracil
  modified_base 195: mod_base = OTHER; note = uracil
  modified_base 202: mod_base = OTHER; note = uracil
  modified_base 207: mod_base = OTHER; note = uracil
  modified_base 208: mod_base = OTHER; note = uracil
  modified_base 210: mod_base = OTHER; note = uracil
  modified_base 213: mod_base = OTHER; note = uracil
  modified_base 215: mod_base = OTHER; note = uracil
  modified_base 220: mod_base = OTHER; note = uracil
  modified_base 225: mod_base = OTHER; note = uracil
  modified_base 227: mod_base = OTHER; note = uracil
  modified_base 241: mod_base = OTHER; note = uracil
  modified_base 243: mod_base = OTHER; note = uracil
  modified_base 246: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 267: mod_base = OTHER; note = uracil
  modified_base 269: mod_base = OTHER; note = uracil
  modified_base 270: mod_base = OTHER; note = uracil
  modified_base 275: mod_base = OTHER; note = uracil
  modified_base 276: mod_base = OTHER; note = uracil
  modified_base 278: mod_base = OTHER; note = uracil
  modified_base 281: mod_base = OTHER; note = uracil
  modified_base 291: mod_base = OTHER; note = uracil
  modified_base 293: mod_base = OTHER; note = uracil
  modified_base 299: mod_base = OTHER; note = uracil
aggagttggaggtttttttttttgttttgygtttggtgtttaggttttggttaggttttttttaattttagtttagattgggttttttttttaaatgtatyggagttgtggtgtgggttaaggttattgttttgtggattttttgggtygttgtatyggtygtgatygtagttagttttttygaygtatagatgttgtgagttagattttagttttggatatattttaggttaggtgtggtattgtttttgtttttaggttttgtgtttttaggttattgtygttttagatttagaggta

SEQ ID NO: 515 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 25: mod_base = OTHER; note = uracil
  modified_base 31: mod_base = OTHER; note = uracil
  modified_base 32: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 81: mod_base = OTHER; note = uracil
  modified_base 84: mod_base = OTHER; note = uracil
  modified_base 85: mod_base = OTHER; note = uracil
  modified_base 88: mod_base = OTHER; note = uracil
  modified_base 89: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 112: mod_base = OTHER; note = uracil
  modified_base 113: mod_base = OTHER; note = uracil
  modified_base 114: mod_base = OTHER; note = uracil
  modified_base 116: mod_base = OTHER; note = uracil
  modified_base 125: mod_base = OTHER; note = uracil
  modified_base 129: mod_base = OTHER; note = uracil
  modified_base 158: mod_base = OTHER; note = uracil
  modified_base 161: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 182: mod_base = OTHER; note = uracil
  modified_base 188: mod_base = OTHER; note = uracil
  modified_base 189: mod_base = OTHER; note = uracil
  modified_base 193: mod_base = OTHER; note = uracil
  modified_base 194: mod_base = OTHER; note = uracil
  modified_base 195: mod_base = OTHER; note = uracil
  modified_base 196: mod_base = OTHER; note = uracil
  modified_base 198: mod_base = OTHER; note = uracil
  modified_base 201: mod_base = OTHER; note = uracil
  modified_base 203: mod_base = OTHER; note = uracil
  modified_base 206: mod_base = OTHER; note = uracil
  modified_base 207: mod_base = OTHER; note = uracil
  modified_base 211: mod_base = OTHER; note = uracil
  modified_base 212: mod_base = OTHER; note = uracil
  modified_base 215: mod_base = OTHER; note = uracil
  modified_base 216: mod_base = OTHER; note = uracil
  modified_base 220: mod_base = OTHER; note = uracil
  modified_base 221: mod_base = OTHER; note = uracil
  modified_base 223: mod_base = OTHER; note = uracil
  modified_base 224: mod_base = OTHER; note = uracil
  modified_base 227: mod_base = OTHER; note = uracil
  modified_base 234: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 250: mod_base = OTHER; note = uracil
  modified_base 251: mod_base = OTHER; note = uracil
  modified_base 252: mod_base = OTHER; note = uracil
  modified_base 256: mod_base = OTHER; note = uracil
  modified_base 259: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 276: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 286: mod_base = OTHER; note = uracil
  modified_base 288: mod_base = OTHER; note = uracil
  modified_base 291: mod_base = OTHER; note = uracil
  modified_base 293: mod_base = OTHER; note = uracil
  modified_base 296: mod_base = OTHER; note = uracil
gtagttttggggygtggggggyggttgttttttgttgttttttgggttgttatttgttygagttgttagttatagttggatttttttttagtttttyggggtgtttgtatttttatattygagataggtagtgagagggagtgaggggygatgatgtttgtagtttataagagttttygggtagtagttaggtttttttgtttagtttgatttgtttggtttttagtagggtgttatggttttgggaggttttggtttttgttttttttttttttttgttttgygttttgttttgttgtg

SEQ ID NO: 516 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 10: mod_base = OTHER; note = uracil
  modified_base 17: mod_base = OTHER; note = uracil
  modified_base 22: mod_base = OTHER; note = uracil
  modified_base 39: mod_base = OTHER; note = uracil
  modified_base 45: mod_base = OTHER; note = uracil
  modified_base 46: mod_base = OTHER; note = uracil
  modified_base 51: mod_base = OTHER; note = uracil
  modified_base 52: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 61: mod_base = OTHER; note = uracil
  modified_base 62: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 74: mod_base = OTHER; note = uracil
  modified_base 81: mod_base = OTHER; note = uracil
  modified_base 82: mod_base = OTHER; note = uracil
  modified_base 86: mod_base = OTHER; note = uracil
  modified_base 91: mod_base = OTHER; note = uracil
  modified_base 95: mod_base = OTHER; note = uracil
  modified_base 100: mod_base = OTHER; note = uracil
  modified_base 108: mod_base = OTHER; note = uracil
  modified_base 109: mod_base = OTHER; note = uracil
  modified_base 113: mod_base = OTHER; note = uracil
  modified_base 116: mod_base = OTHER; note = uracil
  modified_base 119: mod_base = OTHER; note = uracil
  modified_base 120: mod_base = OTHER; note = uracil
  modified_base 127: mod_base = OTHER; note = uracil
  modified_base 129: mod_base = OTHER; note = uracil
  modified_base 137: mod_base = OTHER; note = uracil
  modified_base 140: mod_base = OTHER; note = uracil
  modified_base 144: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 155: mod_base = OTHER; note = uracil
  modified_base 157: mod_base = OTHER; note = uracil
  modified_base 159: mod_base = OTHER; note = uracil
  modified_base 161: mod_base = OTHER; note = uracil
  modified_base 162: mod_base = OTHER; note = uracil
  modified_base 163: mod_base = OTHER; note = uracil
  modified_base 165: mod_base = OTHER; note = uracil
  modified_base 167: mod_base = OTHER; note = uracil
  modified_base 169: mod_base = OTHER; note = uracil
  modified_base 172: mod_base = OTHER; note = uracil
  modified_base 173: mod_base = OTHER; note = uracil
  modified_base 177: mod_base = OTHER; note = uracil
  modified_base 193: mod_base = OTHER; note = uracil
  modified_base 197: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 209: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 231: mod_base = OTHER; note = uracil
  modified_base 235: mod_base = OTHER; note = uracil
  modified_base 238: mod_base = OTHER; note = uracil
  modified_base 244: mod_base = OTHER; note = uracil
  modified_base 251: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 263: mod_base = OTHER; note = uracil
  modified_base 266: mod_base = OTHER; note = uracil
  modified_base 273: mod_base = OTHER; note = uracil
  modified_base 276: mod_base = OTHER; note = uracil
  modified_base 279: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 284: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 299: mod_base = OTHER; note = uracil
  modified_base 300: mod_base = OTHER; note = uracil
atagtagagtagagygtagggtaggggaggaaagggggtagaagttagggttttttagggttatagtattttgttggaggttaggtaggttaggttgagtagaggggtttggttattgttyggaggtttttgtgggttgtagatattatygttttttatttttttttattgtttgtttygaatgtgggaatgtaggtatttyggagggttggaaggaagtttaattgtggttggtagttygggtaggtggtagtttaaggggtagtaggaaatagtygttttttaygttttagggttgtt

SEQ ID NO: 517 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 4: mod_base = OTHER; note = uracil
  modified_base 6: mod_base = OTHER; note = uracil
  modified_base 7: mod_base = OTHER; note = uracil
  modified_base 12: mod_base = OTHER; note = uracil
  modified_base 13: mod_base = OTHER; note = uracil
  modified_base 17: mod_base = OTHER; note = uracil
  modified_base 28: mod_base = OTHER; note = uracil
  modified_base 29: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 40: mod_base = OTHER; note = uracil
  modified_base 50: mod_base = OTHER; note = uracil
  modified_base 54: mod_base = OTHER; note = uracil
  modified_base 59: mod_base = OTHER; note = uracil
  modified_base 65: mod_base = OTHER; note = uracil
  modified_base 69: mod_base = OTHER; note = uracil
  modified_base 71: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 91: mod_base = OTHER; note = uracil
  modified_base 100: mod_base = OTHER; note = uracil
  modified_base 104: mod_base = OTHER; note = uracil
  modified_base 107: mod_base = OTHER; note = uracil
  modified_base 121: mod_base = OTHER; note = uracil
  modified_base 132: mod_base = OTHER; note = uracil
  modified_base 133: mod_base = OTHER; note = uracil
  modified_base 139: mod_base = OTHER; note = uracil
  modified_base 141: mod_base = OTHER; note = uracil
  modified_base 143: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 160: mod_base = OTHER; note = uracil
  modified_base 163: mod_base = OTHER; note = uracil
  modified_base 165: mod_base = OTHER; note = uracil
  modified_base 168: mod_base = OTHER; note = uracil
  modified_base 174: mod_base = OTHER; note = uracil
  modified_base 178: mod_base = OTHER; note = uracil
  modified_base 180: mod_base = OTHER; note = uracil
  modified_base 183: mod_base = OTHER; note = uracil
  modified_base 186: mod_base = OTHER; note = uracil
  modified_base 197: mod_base = OTHER; note = uracil
  modified_base 200: mod_base = OTHER; note = uracil
  modified_base 223: mod_base = OTHER; note = uracil
  modified_base 244: mod_base = OTHER; note = uracil
  modified_base 245: mod_base = OTHER; note = uracil
  modified_base 251: mod_base = OTHER; note = uracil
  modified_base 257: mod_base = OTHER; note = uracil
  modified_base 258: mod_base = OTHER; note = uracil
  modified_base 277: mod_base = OTHER; note = uracil
  modified_base 278: mod_base = OTHER; note = uracil
  modified_base 279: mod_base = OTHER; note = uracil
  modified_base 281: mod_base = OTHER; note = uracil
  modified_base 282: mod_base = OTHER; note = uracil
  modified_base 283: mod_base = OTHER; note = uracil
  modified_base 295: mod_base = OTHER; note = uracil
  modified_base 297: mod_base = OTHER; note = uracil
ttttttttgggttaagttttgtggatgtttagtttggggtygyggggagttggtaggttagtggtagatattggtgggtagatttagtgtttggtagaataggtattaaggaagtggtgatyggagggaagttaagtgtatttaaattttygggtgagttattatygtygggttttttatagttgttgaaagtgagtaatagtgatgaaggtttgtgagtttttgygtgagygagtgaatggattagtagtagtttttaggttgtggaagagygtttttttttygggatggggatatttg

SEQ ID NO: 518 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 8: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 14: mod_base = OTHER; note = uracil
  modified_base 15: mod_base = OTHER; note = uracil
  modified_base 29: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 48: mod_base = OTHER; note = uracil
  modified_base 51: mod_base = OTHER; note = uracil
  modified_base 54: mod_base = OTHER; note = uracil
  modified_base 59: mod_base = OTHER; note = uracil
  modified_base 60: mod_base = OTHER; note = uracil
  modified_base 64: mod_base = OTHER; note = uracil
  modified_base 66: mod_base = OTHER; note = uracil
  modified_base 70: mod_base = OTHER; note = uracil
  modified_base 72: mod_base = OTHER; note = uracil
  modified_base 76: mod_base = OTHER; note = uracil
  modified_base 82: mod_base = OTHER; note = uracil
  modified_base 84: mod_base = OTHER; note = uracil
  modified_base 86: mod_base = OTHER; note = uracil
  modified_base 90: mod_base = OTHER; note = uracil
  modified_base 91: mod_base = OTHER; note = uracil
  modified_base 94: mod_base = OTHER; note = uracil
  modified_base 97: mod_base = OTHER; note = uracil
  modified_base 99: mod_base = OTHER; note = uracil
  modified_base 105: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 116: mod_base = OTHER; note = uracil
  modified_base 119: mod_base = OTHER; note = uracil
  modified_base 129: mod_base = OTHER; note = uracil
  modified_base 130: mod_base = OTHER; note = uracil
  modified_base 143: mod_base = OTHER; note = uracil
  modified_base 145: mod_base = OTHER; note = uracil
  modified_base 147: mod_base = OTHER; note = uracil
  modified_base 148: mod_base = OTHER; note = uracil
  modified_base 163: mod_base = OTHER; note = uracil
  modified_base 165: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 177: mod_base = OTHER; note = uracil
  modified_base 182: mod_base = OTHER; note = uracil
  modified_base 184: mod_base = OTHER; note = uracil
  modified_base 185: mod_base = OTHER; note = uracil
  modified_base 187: mod_base = OTHER; note = uracil
  modified_base 190: mod_base = OTHER; note = uracil
  modified_base 191: mod_base = OTHER; note = uracil
  modified_base 198: mod_base = OTHER; note = uracil
  modified_base 199: mod_base = OTHER; note = uracil
  modified_base 204: mod_base = OTHER; note = uracil
  modified_base 207: mod_base = OTHER; note = uracil
  modified_base 208: mod_base = OTHER; note = uracil
  modified_base 212: mod_base = OTHER; note = uracil
  modified_base 214: mod_base = OTHER; note = uracil
  modified_base 220: mod_base = OTHER; note = uracil
  modified_base 223: mod_base = OTHER; note = uracil
  modified_base 224: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 234: mod_base = OTHER; note = uracil
  modified_base 237: mod_base = OTHER; note = uracil
  modified_base 238: mod_base = OTHER; note = uracil
  modified_base 240: mod_base = OTHER; note = uracil
  modified_base 244: mod_base = OTHER; note = uracil
  modified_base 245: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 254: mod_base = OTHER; note = uracil
  modified_base 255: mod_base = OTHER; note = uracil
  modified_base 256: mod_base = OTHER; note = uracil
  modified_base 262: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 269: mod_base = OTHER; note = uracil
  modified_base 274: mod_base = OTHER; note = uracil
  modified_base 277: mod_base = OTHER; note = uracil
  modified_base 278: mod_base = OTHER; note = uracil
  modified_base 280: mod_base = OTHER; note = uracil
  modified_base 285: mod_base = OTHER; note = uracil
  modified_base 290: mod_base = OTHER; note = uracil
  modified_base 291: mod_base = OTHER; note = uracil
  modified_base 292: mod_base = OTHER; note = uracil
taagtgtttttatttyggggagggaaygtttttttataatttggaaattgttattggtttatttattygtttaygtagaaatttataaatttttattattgttgtttatttttagtagttgtgaaagattyggyggtgatgatttattygagggtttgagtgtatttggttttttttyggttattatttttttgatgtttgttttattagatattaggtttgtttattagtgtttgttattgatttgttagtttttygyggttttaggttgggtatttataaagtttggtttaggagaga

SEQ ID NO: 519 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 8: mod_base = OTHER; note = uracil
  modified_base 14: mod_base = OTHER; note = uracil
  modified_base 16: mod_base = OTHER; note = uracil
  modified_base 17: mod_base = OTHER; note = uracil
  modified_base 22: mod_base = OTHER; note = uracil
  modified_base 24: mod_base = OTHER; note = uracil
  modified_base 30: mod_base = OTHER; note = uracil
  modified_base 32: mod_base = OTHER; note = uracil
  modified_base 33: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 45: mod_base = OTHER; note = uracil
  modified_base 46: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 59: mod_base = OTHER; note = uracil
  modified_base 60: mod_base = OTHER; note = uracil
  modified_base 62: mod_base = OTHER; note = uracil
  modified_base 63: mod_base = OTHER; note = uracil
  modified_base 67: mod_base = OTHER; note = uracil
  modified_base 68: mod_base = OTHER; note = uracil
  modified_base 71: mod_base = OTHER; note = uracil
  modified_base 72: mod_base = OTHER; note = uracil
  modified_base 77: mod_base = OTHER; note = uracil
  modified_base 78: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 91: mod_base = OTHER; note = uracil
  modified_base 94: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 108: mod_base = OTHER; note = uracil
  modified_base 109: mod_base = OTHER; note = uracil
  modified_base 121: mod_base = OTHER; note = uracil
  modified_base 123: mod_base = OTHER; note = uracil
  modified_base 127: mod_base = OTHER; note = uracil
  modified_base 131: mod_base = OTHER; note = uracil
  modified_base 133: mod_base = OTHER; note = uracil
  modified_base 135: mod_base = OTHER; note = uracil
  modified_base 147: mod_base = OTHER; note = uracil
  modified_base 152: mod_base = OTHER; note = uracil
  modified_base 153: mod_base = OTHER; note = uracil
  modified_base 154: mod_base = OTHER; note = uracil
  modified_base 156: mod_base = OTHER; note = uracil
  modified_base 157: mod_base = OTHER; note = uracil
  modified_base 168: mod_base = OTHER; note = uracil
  modified_base 173: mod_base = OTHER; note = uracil
  modified_base 194: mod_base = OTHER; note = uracil
  modified_base 200: mod_base = OTHER; note = uracil
  modified_base 207: mod_base = OTHER; note = uracil
  modified_base 214: mod_base = OTHER; note = uracil
  modified_base 218: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 241: mod_base = OTHER; note = uracil
  modified_base 248: mod_base = OTHER; note = uracil
  modified_base 251: mod_base = OTHER; note = uracil
  modified_base 252: mod_base = OTHER; note = uracil
  modified_base 263: mod_base = OTHER; note = uracil
  modified_base 268: mod_base = OTHER; note = uracil
  modified_base 272: mod_base = OTHER; note = uracil
  modified_base 275: mod_base = OTHER; note = uracil
  modified_base 277: mod_base = OTHER; note = uracil
ggttggttttgaatttttgggtttaagagttttatttgttttagttttttaaagtgagttattaggtttattyggttttttttttttatgtttttgtggtttttttttttgtttagygagttttgatatttatttataggtaggaataaagttttttattggttagtttgggttgaggtgggygtgtgtgtttttgtattagtgatttgtttttyggtaggtttttttttgaggggagagttggtagtttttatgtaagtggtagggtatattttattaaataaaagatgtgtgggtgag

SEQ ID NO: 520 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 7: mod_base = OTHER; note = uracil
  modified_base 9: mod_base = OTHER; note = uracil
  modified_base 11: mod_base = OTHER; note = uracil
  modified_base 14: mod_base = OTHER; note = uracil
  modified_base 34: mod_base = OTHER; note = uracil
  modified_base 35: mod_base = OTHER; note = uracil
  modified_base 36: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 46: mod_base = OTHER; note = uracil
  modified_base 54: mod_base = OTHER; note = uracil
  modified_base 57: mod_base = OTHER; note = uracil
  modified_base 58: mod_base = OTHER; note = uracil
  modified_base 61: mod_base = OTHER; note = uracil
  modified_base 63: mod_base = OTHER; note = uracil
  modified_base 65: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 70: mod_base = OTHER; note = uracil
  modified_base 80: mod_base = OTHER; note = uracil
  modified_base 81: mod_base = OTHER; note = uracil
  modified_base 84: mod_base = OTHER; note = uracil
  modified_base 92: mod_base = OTHER; note = uracil
  modified_base 97: mod_base = OTHER; note = uracil
  modified_base 99: mod_base = OTHER; note = uracil
  modified_base 105: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 124: mod_base = OTHER; note = uracil
  modified_base 126: mod_base = OTHER; note = uracil
  modified_base 129: mod_base = OTHER; note = uracil
  modified_base 130: mod_base = OTHER; note = uracil
  modified_base 131: mod_base = OTHER; note = uracil
  modified_base 135: mod_base = OTHER; note = uracil
  modified_base 139: mod_base = OTHER; note = uracil
  modified_base 140: mod_base = OTHER; note = uracil
  modified_base 150: mod_base = OTHER; note = uracil
  modified_base 157: mod_base = OTHER; note = uracil
  modified_base 158: mod_base = OTHER; note = uracil
  modified_base 161: mod_base = OTHER; note = uracil
  modified_base 162: mod_base = OTHER; note = uracil
  modified_base 176: mod_base = OTHER; note = uracil
  modified_base 181: mod_base = OTHER; note = uracil
  modified_base 185: mod_base = OTHER; note = uracil
  modified_base 190: mod_base = OTHER; note = uracil
  modified_base 202: mod_base = OTHER; note = uracil
  modified_base 203: mod_base = OTHER; note = uracil
  modified_base 205: mod_base = OTHER; note = uracil
  modified_base 211: mod_base = OTHER; note = uracil
  modified_base 226: mod_base = OTHER; note = uracil
  modified_base 235: mod_base = OTHER; note = uracil
  modified_base 236: mod_base = OTHER; note = uracil
  modified_base 243: mod_base = OTHER; note = uracil
  modified_base 245: mod_base = OTHER; note = uracil
  modified_base 247: mod_base = OTHER; note = uracil
  modified_base 257: mod_base = OTHER; note = uracil
  modified_base 263: mod_base = OTHER; note = uracil
  modified_base 272: mod_base = OTHER; note = uracil
  modified_base 274: mod_base = OTHER; note = uracil
  modified_base 280: mod_base = OTHER; note = uracil
  modified_base 281: mod_base = OTHER; note = uracil
  modified_base 282: mod_base = OTHER; note = uracil
  modified_base 290: mod_base = OTHER; note = uracil
  modified_base 295: mod_base = OTHER; note = uracil
  modified_base 296: mod_base = OTHER; note = uracil
  modified_base 299: mod_base = OTHER; note = uracil
  modified_base 300: mod_base = OTHER; note = uracil
tttatttatatattttttatttagtgaagtatgttttgttatttatatggaagttattagttttttttttagggagaggtttgtyggaaaatagattattgatatagaaatatataygtttattttagtttagattaattaatggagggttttgtttttatttatgagtgaatgttagagttygttaaataggaggaaaggttatagaagtatggaggaaaaggatygggtaggtttggtggtttattttgggaggttgaggtaggtggagtttttgagtttaggagtttaagattagtt

SEQ ID NO: 521 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 8: mod_base = OTHER; note = uracil
  modified_base 23: mod_base = OTHER; note = uracil
  modified_base 26: mod_base = OTHER; note = uracil
  modified_base 31: mod_base = OTHER; note = uracil
  modified_base 34: mod_base = OTHER; note = uracil
  modified_base 35: mod_base = OTHER; note = uracil
  modified_base 37: mod_base = OTHER; note = uracil
  modified_base 38: mod_base = OTHER; note = uracil
  modified_base 44: mod_base = OTHER; note = uracil
  modified_base 47: mod_base = OTHER; note = uracil
  modified_base 54: mod_base = OTHER; note = uracil
  modified_base 55: mod_base = OTHER; note = uracil
  modified_base 56: mod_base = OTHER; note = uracil
  modified_base 57: mod_base = OTHER; note = uracil
  modified_base 59: mod_base = OTHER; note = uracil
  modified_base 60: mod_base = OTHER; note = uracil
  modified_base 63: mod_base = OTHER; note = uracil
  modified_base 64: mod_base = OTHER; note = uracil
  modified_base 66: mod_base = OTHER; note = uracil
  modified_base 67: mod_base = OTHER; note = uracil
  modified_base 69: mod_base = OTHER; note = uracil
  modified_base 70: mod_base = OTHER; note = uracil
  modified_base 73: mod_base = OTHER; note = uracil
  modified_base 77: mod_base = OTHER; note = uracil
  modified_base 81: mod_base = OTHER; note = uracil
  modified_base 83: mod_base = OTHER; note = uracil
  modified_base 88: mod_base = OTHER; note = uracil
  modified_base 89: mod_base = OTHER; note = uracil
  modified_base 91: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 110: mod_base = OTHER; note = uracil
  modified_base 111: mod_base = OTHER; note = uracil
  modified_base 116: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 127: mod_base = OTHER; note = uracil
  modified_base 130: mod_base = OTHER; note = uracil
  modified_base 131: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 153: mod_base = OTHER; note = uracil
  modified_base 156: mod_base = OTHER; note = uracil
  modified_base 158: mod_base = OTHER; note = uracil
  modified_base 161: mod_base = OTHER; note = uracil
  modified_base 163: mod_base = OTHER; note = uracil
  modified_base 170: mod_base = OTHER; note = uracil
  modified_base 171: mod_base = OTHER; note = uracil
  modified_base 175: mod_base = OTHER; note = uracil
  modified_base 176: mod_base = OTHER; note = uracil
  modified_base 178: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 190: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 200: mod_base = OTHER; note = uracil
  modified_base 212: mod_base = OTHER; note = uracil
  modified_base 213: mod_base = OTHER; note = uracil
  modified_base 219: mod_base = OTHER; note = uracil
  modified_base 220: mod_base = OTHER; note = uracil
  modified_base 224: mod_base = OTHER; note = uracil
  modified_base 239: mod_base = OTHER; note = uracil
  modified_base 240: mod_base = OTHER; note = uracil
  modified_base 242: mod_base = OTHER; note = uracil
  modified_base 243: mod_base = OTHER; note = uracil
  modified_base 245: mod_base = OTHER; note = uracil
  modified_base 246: mod_base = OTHER; note = uracil
  modified_base 253: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 262: mod_base = OTHER; note = uracil
  modified_base 265: mod_base = OTHER; note = uracil
  modified_base 266: mod_base = OTHER; note = uracil
  modified_base 269: mod_base = OTHER; note = uracil
  modified_base 271: mod_base = OTHER; note = uracil
  modified_base 272: mod_base = OTHER; note = uracil
  modified_base 274: mod_base = OTHER; note = uracil
  modified_base 278: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 295: mod_base = OTHER; note = uracil
  modified_base 296: mod_base = OTHER; note = uracil
  modified_base 299: mod_base = OTHER; note = uracil
taagtattttagtgatgtgagttattaaaatttttttttgggtttgttttgagttttatttttttttttttgtagttatgtttttagttttagggttttggggyggaygttyggatatttttttagtagtttgttttttagaggttattgygttgtttagtttygggggttygtttttygtggatttttttaggtttagtagagtgtttgattaygggtttgatygggaggggagaygttattttttggggatttgtattttaattagtattattgttatgagatattyggaggttagta

SEQ ID NO: 522 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 18: mod_base = OTHER; note = uracil
  modified_base 20: mod_base = OTHER; note = uracil
  modified_base 25: mod_base = OTHER; note = uracil
  modified_base 33: mod_base = OTHER; note = uracil
  modified_base 45: mod_base = OTHER; note = uracil
  modified_base 50: mod_base = OTHER; note = uracil
  modified_base 51: mod_base = OTHER; note = uracil
  modified_base 52: mod_base = OTHER; note = uracil
  modified_base 53: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 73: mod_base = OTHER; note = uracil
  modified_base 74: mod_base = OTHER; note = uracil
  modified_base 79: mod_base = OTHER; note = uracil
  modified_base 83: mod_base = OTHER; note = uracil
  modified_base 84: mod_base = OTHER; note = uracil
  modified_base 91: mod_base = OTHER; note = uracil
  modified_base 95: mod_base = OTHER; note = uracil
  modified_base 97: mod_base = OTHER; note = uracil
  modified_base 99: mod_base = OTHER; note = uracil
  modified_base 102: mod_base = OTHER; note = uracil
  modified_base 107: mod_base = OTHER; note = uracil
  modified_base 108: mod_base = OTHER; note = uracil
  modified_base 118: mod_base = OTHER; note = uracil
  modified_base 119: mod_base = OTHER; note = uracil
  modified_base 132: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 141: mod_base = OTHER; note = uracil
  modified_base 146: mod_base = OTHER; note = uracil
  modified_base 151: mod_base = OTHER; note = uracil
  modified_base 157: mod_base = OTHER; note = uracil
  modified_base 158: mod_base = OTHER; note = uracil
  modified_base 160: mod_base = OTHER; note = uracil
  modified_base 168: mod_base = OTHER; note = uracil
  modified_base 172: mod_base = OTHER; note = uracil
  modified_base 175: mod_base = OTHER; note = uracil
  modified_base 187: mod_base = OTHER; note = uracil
  modified_base 195: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 201: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 214: mod_base = OTHER; note = uracil
  modified_base 221: mod_base = OTHER; note = uracil
  modified_base 226: mod_base = OTHER; note = uracil
  modified_base 229: mod_base = OTHER; note = uracil
  modified_base 248: mod_base = OTHER; note = uracil
  modified_base 250: mod_base = OTHER; note = uracil
  modified_base 255: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 280: mod_base = OTHER; note = uracil
  modified_base 282: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 297: mod_base = OTHER; note = uracil
tgttggttttygggtgttttatgatagtggtgttggttggggtgtaagtttttaggaggtggygttttttttttyggttaggttygtggttaaatattttgttgggtttggagggatttayggaggaygggttttyggagttgagtagygtagtggtttttggaaagtaggttgttgggggagtgttygggygttygttttagggttttgaggttaagagtatgattgtaggaggaggaaggtggggtttaaagtagatttaggaggaagttttgatgatttatattattaagatgtttg

SEQ ID NO: 523 - DNA, 300 bp, synthetic construct
  misc_feature 1..300: note = Synthetic polynucleotide
  source 1..300: mol_type = other DNA
  modified_base 7: mod_base = OTHER; note = uracil
  modified_base 8: mod_base = OTHER; note = uracil
  modified_base 12: mod_base = OTHER; note = uracil
  modified_base 14: mod_base = OTHER; note = uracil
  modified_base 17: mod_base = OTHER; note = uracil
  modified_base 22: mod_base = OTHER; note = uracil
  modified_base 29: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 45: mod_base = OTHER; note = uracil
  modified_base 46: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 84: mod_base = OTHER; note = uracil
  modified_base 86: mod_base = OTHER; note = uracil
  modified_base 88: mod_base = OTHER; note = uracil
  modified_base 90: mod_base = OTHER; note = uracil
  modified_base 91: mod_base = OTHER; note = uracil
  modified_base 96: mod_base = OTHER; note = uracil
  modified_base 98: mod_base = OTHER; note = uracil
  modified_base 99: mod_base = OTHER; note = uracil
  modified_base 101: mod_base = OTHER; note = uracil
  modified_base 102: mod_base = OTHER; note = uracil
  modified_base 104: mod_base = OTHER; note = uracil
  modified_base 105: mod_base = OTHER; note = uracil
  modified_base 108: mod_base = OTHER; note = uracil
  modified_base 109: mod_base = OTHER; note = uracil
  modified_base 116: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 125: mod_base = OTHER; note = uracil
  modified_base 127: mod_base = OTHER; note = uracil
  modified_base 128: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 139: mod_base = OTHER; note = uracil
  modified_base 143: mod_base = OTHER; note = uracil
  modified_base 145: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 166: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 185: mod_base = OTHER; note = uracil
  modified_base 186: mod_base = OTHER; note = uracil
  modified_base 187: mod_base = OTHER; note = uracil
  modified_base 188: mod_base = OTHER; note = uracil
  modified_base 191: mod_base = OTHER; note = uracil
  modified_base 192: mod_base = OTHER; note = uracil
  modified_base 199: mod_base = OTHER; note = uracil
  modified_base 202: mod_base = OTHER; note = uracil
  modified_base 204: mod_base = OTHER; note = uracil
  modified_base 212: mod_base = OTHER; note = uracil
  modified_base 213: mod_base = OTHER; note = uracil
  modified_base 218: mod_base = OTHER; note = uracil
  modified_base 219: mod_base = OTHER; note = uracil
  modified_base 223: mod_base = OTHER; note = uracil
  modified_base 228: mod_base = OTHER; note = uracil
  modified_base 231: mod_base = OTHER; note = uracil
  modified_base 240: mod_base = OTHER; note = uracil
  modified_base 241: mod_base = OTHER; note = uracil
  modified_base 252: mod_base = OTHER; note = uracil
  modified_base 253: mod_base = OTHER; note = uracil
  modified_base 262: mod_base = OTHER; note = uracil
  modified_base 269: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 280: mod_base = OTHER; note = uracil
  modified_base 289: mod_base = OTHER; note = uracil
tgatgattaggtattgttattttttaggtygggatttttttaagttttggtatttttaaaaataygttatagtttttttgaaattttttttttattatttttatttttttgtttttattttttattttttggtattttttgtttttttayggtgtttttatgaygttgtttgtatgtttattggttttagtttgggagttttttagagaygttygggttagatatggttgtagatagagttaagagggtggtttygggtggttggtggtagttttttggttgtgggggtagaagtggggg

SEQ ID NO: 524 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 4: mod_base = OTHER; note = uracil
  modified_base 5: mod_base = OTHER; note = uracil
  modified_base 7: mod_base = OTHER; note = uracil
  modified_base 10: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 19: mod_base = OTHER; note = uracil
  modified_base 22: mod_base = OTHER; note = uracil
  modified_base 23: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 40: mod_base = OTHER; note = uracil
  modified_base 41: mod_base = OTHER; note = uracil
  modified_base 43: mod_base = OTHER; note = uracil
  modified_base 44: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 57: mod_base = OTHER; note = uracil
  modified_base 62: mod_base = OTHER; note = uracil
  modified_base 64: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 80: mod_base = OTHER; note = uracil
  modified_base 84: mod_base = OTHER; note = uracil
  modified_base 85: mod_base = OTHER; note = uracil
  modified_base 93: mod_base = OTHER; note = uracil
  modified_base 95: mod_base = OTHER; note = uracil
  modified_base 103: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 111: mod_base = OTHER; note = uracil
  modified_base 117: mod_base = OTHER; note = uracil
  modified_base 118: mod_base = OTHER; note = uracil
  modified_base 125: mod_base = OTHER; note = uracil
  modified_base 129: mod_base = OTHER; note = uracil
  modified_base 133: mod_base = OTHER; note = uracil
  modified_base 139: mod_base = OTHER; note = uracil
  modified_base 147: mod_base = OTHER; note = uracil
  modified_base 149: mod_base = OTHER; note = uracil
  modified_base 160: mod_base = OTHER; note = uracil
  modified_base 169: mod_base = OTHER; note = uracil
  modified_base 170: mod_base = OTHER; note = uracil
  modified_base 190: mod_base = OTHER; note = uracil
  modified_base 221: mod_base = OTHER; note = uracil
  modified_base 229: mod_base = OTHER; note = uracil
  modified_base 251: mod_base = OTHER; note = uracil
  modified_base 252: mod_base = OTHER; note = uracil
  modified_base 257: mod_base = OTHER; note = uracil
  modified_base 268: mod_base = OTHER; note = uracil
  modified_base 269: mod_base = OTHER; note = uracil
  modified_base 273: mod_base = OTHER; note = uracil
  modified_base 274: mod_base = OTHER; note = uracil
  modified_base 285: mod_base = OTHER; note = uracil
  modified_base 290: mod_base = OTHER; note = uracil
  modified_base 291: mod_base = OTHER; note = uracil
  modified_base 296: mod_base = OTHER; note = uracil
  modified_base 299: mod_base = OTHER; note = uracil
tttttatttttgtttttatagttaggagattgttattagttattygaggttatttttttggttttatttgtagttatgtttggttygggygtttttgagaagtttttaggttggggttaatgggtatgtaggtagygttatggggatatygtggggagatagagggtgttaaggagtgggagatgaaaataggaaggtggaggtgataaggagagagttttaagggaattataaygtatttttaaaaatattaaggtttggggaaatttyggtttaaagaatagtagtgtttggttatta

SEQ ID NO: 525 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 3: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 16: mod_base = OTHER; note = uracil
  modified_base 18: mod_base = OTHER; note = uracil
  modified_base 22: mod_base = OTHER; note = uracil
  modified_base 30: mod_base = OTHER; note = uracil
  modified_base 32: mod_base = OTHER; note = uracil
  modified_base 34: mod_base = OTHER; note = uracil
  modified_base 43: mod_base = OTHER; note = uracil
  modified_base 44: mod_base = OTHER; note = uracil
  modified_base 52: mod_base = OTHER; note = uracil
  modified_base 57: mod_base = OTHER; note = uracil
  modified_base 58: mod_base = OTHER; note = uracil
  modified_base 59: mod_base = OTHER; note = uracil
  modified_base 61: mod_base = OTHER; note = uracil
  modified_base 65: mod_base = OTHER; note = uracil
  modified_base 66: mod_base = OTHER; note = uracil
  modified_base 76: mod_base = OTHER; note = uracil
  modified_base 80: mod_base = OTHER; note = uracil
  modified_base 81: mod_base = OTHER; note = uracil
  modified_base 83: mod_base = OTHER; note = uracil
  modified_base 84: mod_base = OTHER; note = uracil
  modified_base 87: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 105: mod_base = OTHER; note = uracil
  modified_base 106: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 122: mod_base = OTHER; note = uracil
  modified_base 123: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 133: mod_base = OTHER; note = uracil
  modified_base 135: mod_base = OTHER; note = uracil
  modified_base 136: mod_base = OTHER; note = uracil
  modified_base 137: mod_base = OTHER; note = uracil
  modified_base 138: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 160: mod_base = OTHER; note = uracil
  modified_base 161: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 183: mod_base = OTHER; note = uracil
  modified_base 184: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 190: mod_base = OTHER; note = uracil
  modified_base 198: mod_base = OTHER; note = uracil
  modified_base 202: mod_base = OTHER; note = uracil
  modified_base 206: mod_base = OTHER; note = uracil
  modified_base 207: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 235: mod_base = OTHER; note = uracil
  modified_base 241: mod_base = OTHER; note = uracil
  modified_base 245: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 252: mod_base = OTHER; note = uracil
  modified_base 253: mod_base = OTHER; note = uracil
  modified_base 254: mod_base = OTHER; note = uracil
  modified_base 258: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 284: mod_base = OTHER; note = uracil
  modified_base 290: mod_base = OTHER; note = uracil
  modified_base 292: mod_base = OTHER; note = uracil
  modified_base 295: mod_base = OTHER; note = uracil
  modified_base 298: mod_base = OTHER; note = uracil
gtttagtttygygygtatatataygtgtgtttttygygyggatttygggaattttgtttttaygttygyggygygtttgtttttygttygtttyggtttttattttttygagatgttttttttttagtyggtttttttttttttyggttygggaagaagtttgttgggttagggygttttgattattttttyggaggtyggtaaatttgtttgaatygttttagaggaatygggtaggggttygtattttatttyggtaggagggtttygagatygattygggtyggggtttygtagtyg

SEQ ID NO: 526 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 18: mod_base = OTHER; note = uracil
  modified_base 19: mod_base = OTHER; note = uracil
  modified_base 29: mod_base = OTHER; note = uracil
  modified_base 36: mod_base = OTHER; note = uracil
  modified_base 37: mod_base = OTHER; note = uracil
  modified_base 38: mod_base = OTHER; note = uracil
  modified_base 40: mod_base = OTHER; note = uracil
  modified_base 41: mod_base = OTHER; note = uracil
  modified_base 44: mod_base = OTHER; note = uracil
  modified_base 61: mod_base = OTHER; note = uracil
  modified_base 62: mod_base = OTHER; note = uracil
  modified_base 63: mod_base = OTHER; note = uracil
  modified_base 64: mod_base = OTHER; note = uracil
  modified_base 67: mod_base = OTHER; note = uracil
  modified_base 68: mod_base = OTHER; note = uracil
  modified_base 74: mod_base = OTHER; note = uracil
  modified_base 75: mod_base = OTHER; note = uracil
  modified_base 77: mod_base = OTHER; note = uracil
  modified_base 88: mod_base = OTHER; note = uracil
  modified_base 92: mod_base = OTHER; note = uracil
  modified_base 100: mod_base = OTHER; note = uracil
  modified_base 104: mod_base = OTHER; note = uracil
  modified_base 105: mod_base = OTHER; note = uracil
  modified_base 107: mod_base = OTHER; note = uracil
  modified_base 120: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 133: mod_base = OTHER; note = uracil
  modified_base 134: mod_base = OTHER; note = uracil
  modified_base 135: mod_base = OTHER; note = uracil
  modified_base 138: mod_base = OTHER; note = uracil
  modified_base 142: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 154: mod_base = OTHER; note = uracil
  modified_base 170: mod_base = OTHER; note = uracil
  modified_base 174: mod_base = OTHER; note = uracil
  modified_base 186: mod_base = OTHER; note = uracil
  modified_base 189: mod_base = OTHER; note = uracil
  modified_base 205: mod_base = OTHER; note = uracil
  modified_base 222: mod_base = OTHER; note = uracil
  modified_base 230: mod_base = OTHER; note = uracil
  modified_base 245: mod_base = OTHER; note = uracil
  modified_base 252: mod_base = OTHER; note = uracil
  modified_base 253: mod_base = OTHER; note = uracil
  modified_base 260: mod_base = OTHER; note = uracil
  modified_base 272: mod_base = OTHER; note = uracil
  modified_base 274: mod_base = OTHER; note = uracil
  modified_base 295: mod_base = OTHER; note = uracil
  modified_base 300: mod_base = OTHER; note = uracil
yggttgyggagtttyggttygggtyggtttyggggtttttttgtyggggtggggtgygagtttttgttygatttttttggggyggtttaggtaggtttgtyggttttygaggaggtggttagggygttttggtttagtaggttttttttygagtyggggggaggggagatyggttggggaaggggtatttygaaggggtggaggtyggggygggygggaggtaagygygtygygggygtgagggtaaagttttygaggttygygyggagagtataygtgtatgtgygygyggggttaggt

SEQ ID NO: 527 - DNA, 300 bp, synthetic construct
  misc_feature 1..300: note = Synthetic polynucleotide
  source 1..300: mol_type = other DNA
  modified_base 14: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 24: mod_base = OTHER; note = uracil
  modified_base 29: mod_base = OTHER; note = uracil
  modified_base 40: mod_base = OTHER; note = uracil
  modified_base 58: mod_base = OTHER; note = uracil
  modified_base 62: mod_base = OTHER; note = uracil
  modified_base 67: mod_base = OTHER; note = uracil
  modified_base 79: mod_base = OTHER; note = uracil
  modified_base 88: mod_base = OTHER; note = uracil
  modified_base 97: mod_base = OTHER; note = uracil
  modified_base 115: mod_base = OTHER; note = uracil
  modified_base 121: mod_base = OTHER; note = uracil
  modified_base 125: mod_base = OTHER; note = uracil
  modified_base 128: mod_base = OTHER; note = uracil
  modified_base 129: mod_base = OTHER; note = uracil
  modified_base 134: mod_base = OTHER; note = uracil
  modified_base 135: mod_base = OTHER; note = uracil
  modified_base 145: mod_base = OTHER; note = uracil
  modified_base 148: mod_base = OTHER; note = uracil
  modified_base 153: mod_base = OTHER; note = uracil
  modified_base 162: mod_base = OTHER; note = uracil
  modified_base 163: mod_base = OTHER; note = uracil
  modified_base 172: mod_base = OTHER; note = uracil
  modified_base 174: mod_base = OTHER; note = uracil
  modified_base 175: mod_base = OTHER; note = uracil
  modified_base 201: mod_base = OTHER; note = uracil
  modified_base 202: mod_base = OTHER; note = uracil
  modified_base 213: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 229: mod_base = OTHER; note = uracil
  modified_base 235: mod_base = OTHER; note = uracil
  modified_base 237: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 282: mod_base = OTHER; note = uracil
  modified_base 289: mod_base = OTHER; note = uracil
gaaayggyggtygtagttttyggtygggtaygygtggggtygttygtggagyggtgttttgttaggtyggttggggtatttgyggggtyggatgggtttgagggtgagyggyggttggggtaggttgttaaagttygggtggatttgtttgtttttgaatgttttgatggtttttagaggggtaatagggggygggttgattyggatggggtttatgttttggaagggtttgtgtttyggaatggagtttatgtygttggggtggtggtagaggttgtagttaggaattatggggaagag

SEQ ID NO: 528 - DNA, 301 bp, synthetic construct
  misc_feature 1..301: note = Synthetic polynucleotide
  source 1..301: mol_type = other DNA
  modified_base 1: mod_base = OTHER; note = uracil
  modified_base 3: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 9: mod_base = OTHER; note = uracil
  modified_base 16: mod_base = OTHER; note = uracil
  modified_base 17: mod_base = OTHER; note = uracil
  modified_base 21: mod_base = OTHER; note = uracil
  modified_base 24: mod_base = OTHER; note = uracil
  modified_base 27: mod_base = OTHER; note = uracil
  modified_base 28: mod_base = OTHER; note = uracil
  modified_base 30: mod_base = OTHER; note = uracil
  modified_base 33: mod_base = OTHER; note = uracil
  modified_base 34: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 42: mod_base = OTHER; note = uracil
  modified_base 48: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 61: mod_base = OTHER; note = uracil
  modified_base 67: mod_base = OTHER; note = uracil
  modified_base 69: mod_base = OTHER; note = uracil
  modified_base 73: mod_base = OTHER; note = uracil
  modified_base 74: mod_base = OTHER; note = uracil
  modified_base 75: mod_base = OTHER; note = uracil
  modified_base 78: mod_base = OTHER; note = uracil
  modified_base 79: mod_base = OTHER; note = uracil
  modified_base 84: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 96: mod_base = OTHER; note = uracil
  modified_base 102: mod_base = OTHER; note = uracil
  modified_base 105: mod_base = OTHER; note = uracil
  modified_base 106: mod_base = OTHER; note = uracil
  modified_base 109: mod_base = OTHER; note = uracil
  modified_base 110: mod_base = OTHER; note = uracil
  modified_base 111: mod_base = OTHER; note = uracil
  modified_base 112: mod_base = OTHER; note = uracil
  modified_base 113: mod_base = OTHER; note = uracil
  modified_base 119: mod_base = OTHER; note = uracil
  modified_base 120: mod_base = OTHER; note = uracil
  modified_base 121: mod_base = OTHER; note = uracil
  modified_base 122: mod_base = OTHER; note = uracil
  modified_base 124: mod_base = OTHER; note = uracil
  modified_base 131: mod_base = OTHER; note = uracil
  modified_base 132: mod_base = OTHER; note = uracil
  modified_base 135: mod_base = OTHER; note = uracil
  modified_base 140: mod_base = OTHER; note = uracil
  modified_base 144: mod_base = OTHER; note = uracil
  modified_base 150: mod_base = OTHER; note = uracil
  modified_base 154: mod_base = OTHER; note = uracil
  modified_base 159: mod_base = OTHER; note = uracil
  modified_base 160: mod_base = OTHER; note = uracil
  modified_base 162: mod_base = OTHER; note = uracil
  modified_base 163: mod_base = OTHER; note = uracil
  modified_base 168: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 187: mod_base = OTHER; note = uracil
  modified_base 190: mod_base = OTHER; note = uracil
  modified_base 194: mod_base = OTHER; note = uracil
  modified_base 196: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 202: mod_base = OTHER; note = uracil
  modified_base 206: mod_base = OTHER; note = uracil
  modified_base 207: mod_base = OTHER; note = uracil
  modified_base 208: mod_base = OTHER; note = uracil
  modified_base 211: mod_base = OTHER; note = uracil
  modified_base 215: mod_base = OTHER; note = uracil
  modified_base 216: mod_base = OTHER; note = uracil
  modified_base 217: mod_base = OTHER; note = uracil
  modified_base 220: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 236: mod_base = OTHER; note = uracil
  modified_base 237: mod_base = OTHER; note = uracil
  modified_base 241: mod_base = OTHER; note = uracil
  modified_base 246: mod_base = OTHER; note = uracil
  modified_base 248: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 263: mod_base = OTHER; note = uracil
  modified_base 264: mod_base = OTHER; note = uracil
  modified_base 265: mod_base = OTHER; note = uracil
  modified_base 266: mod_base = OTHER; note = uracil
  modified_base 274: mod_base = OTHER; note = uracil
  modified_base 275: mod_base = OTHER; note = uracil
  modified_base 279: mod_base = OTHER; note = uracil
  modified_base 286: mod_base = OTHER; note = uracil
  modified_base 292: mod_base = OTHER; note = uracil
  modified_base 295: mod_base = OTHER; note = uracil
  modified_base 301: mod_base = OTHER; note = uracil
tttttttttatgatttttgattataatttttattattattttaaygatatgggttttatttyggagtataagtttttttagggtatggattttattygggttaattygttttttattatttttttggagattattaaggtatttaaagataagtagatttattygggttttggtagtttgttttagtygtyygtttatttttaagtttattyggtttygtaagtattttaatyggtttagtaagatatygttttaygaayggttttaygygtgttyggtygagggttgygatygtygtttt

SEQ ID NO: 529 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 4: mod_base = OTHER; note = uracil
  modified_base 5: mod_base = OTHER; note = uracil
  modified_base 9: mod_base = OTHER; note = uracil
  modified_base 17: mod_base = OTHER; note = uracil
  modified_base 23: mod_base = OTHER; note = uracil
  modified_base 29: mod_base = OTHER; note = uracil
  modified_base 34: mod_base = OTHER; note = uracil
  modified_base 36: mod_base = OTHER; note = uracil
  modified_base 38: mod_base = OTHER; note = uracil
  modified_base 41: mod_base = OTHER; note = uracil
  modified_base 44: mod_base = OTHER; note = uracil
  modified_base 45: mod_base = OTHER; note = uracil
  modified_base 47: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 61: mod_base = OTHER; note = uracil
  modified_base 65: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 85: mod_base = OTHER; note = uracil
  modified_base 87: mod_base = OTHER; note = uracil
  modified_base 94: mod_base = OTHER; note = uracil
  modified_base 103: mod_base = OTHER; note = uracil
  modified_base 107: mod_base = OTHER; note = uracil
  modified_base 111: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 119: mod_base = OTHER; note = uracil
  modified_base 121: mod_base = OTHER; note = uracil
  modified_base 122: mod_base = OTHER; note = uracil
  modified_base 123: mod_base = OTHER; note = uracil
  modified_base 126: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 170: mod_base = OTHER; note = uracil
  modified_base 174: mod_base = OTHER; note = uracil
  modified_base 179: mod_base = OTHER; note = uracil
  modified_base 181: mod_base = OTHER; note = uracil
  modified_base 185: mod_base = OTHER; note = uracil
  modified_base 187: mod_base = OTHER; note = uracil
  modified_base 188: mod_base = OTHER; note = uracil
  modified_base 192: mod_base = OTHER; note = uracil
  modified_base 193: mod_base = OTHER; note = uracil
  modified_base 195: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 207: mod_base = OTHER; note = uracil
  modified_base 210: mod_base = OTHER; note = uracil
  modified_base 211: mod_base = OTHER; note = uracil
  modified_base 216: mod_base = OTHER; note = uracil
  modified_base 217: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 228: mod_base = OTHER; note = uracil
  modified_base 247: mod_base = OTHER; note = uracil
  modified_base 248: mod_base = OTHER; note = uracil
  modified_base 250: mod_base = OTHER; note = uracil
  modified_base 253: mod_base = OTHER; note = uracil
  modified_base 255: mod_base = OTHER; note = uracil
  modified_base 256: mod_base = OTHER; note = uracil
  modified_base 261: mod_base = OTHER; note = uracil
  modified_base 291: mod_base = OTHER; note = uracil
  modified_base 296: mod_base = OTHER; note = uracil
  modified_base 297: mod_base = OTHER; note = uracil
tgtttaggttggagtgtagtggtaaaattttggtttattttaattttygtttttygggtttaagtaatttttttgttttagttttttaagtagttgggattataggtatgtattattatatttagttgattttgtatttttagtagagayggggttttattaygttgtttaagttggttttaaatttttgattttaggtgatttattygttttggttttttaaagtgtygggattataggtgtgagttatygtatttgggtaattagtattgtatttaagagtttatatttatatttata

SEQ ID NO: 530 - DNA, 300 bp, synthetic construct
  misc_feature 1..300: note = Synthetic polynucleotide
  source 1..300: mol_type = other DNA
  modified_base 19: mod_base = OTHER; note = uracil
  modified_base 21: mod_base = OTHER; note = uracil
  modified_base 29: mod_base = OTHER; note = uracil
  modified_base 34: mod_base = OTHER; note = uracil
  modified_base 41: mod_base = OTHER; note = uracil
  modified_base 42: mod_base = OTHER; note = uracil
  modified_base 43: mod_base = OTHER; note = uracil
  modified_base 55: mod_base = OTHER; note = uracil
  modified_base 57: mod_base = OTHER; note = uracil
  modified_base 59: mod_base = OTHER; note = uracil
  modified_base 61: mod_base = OTHER; note = uracil
  modified_base 62: mod_base = OTHER; note = uracil
  modified_base 69: mod_base = OTHER; note = uracil
  modified_base 70: mod_base = OTHER; note = uracil
  modified_base 74: mod_base = OTHER; note = uracil
  modified_base 76: mod_base = OTHER; note = uracil
  modified_base 86: mod_base = OTHER; note = uracil
  modified_base 87: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 111: mod_base = OTHER; note = uracil
  modified_base 124: mod_base = OTHER; note = uracil
  modified_base 125: mod_base = OTHER; note = uracil
  modified_base 128: mod_base = OTHER; note = uracil
  modified_base 134: mod_base = OTHER; note = uracil
  modified_base 147: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 155: mod_base = OTHER; note = uracil
  modified_base 158: mod_base = OTHER; note = uracil
  modified_base 167: mod_base = OTHER; note = uracil
  modified_base 173: mod_base = OTHER; note = uracil
  modified_base 176: mod_base = OTHER; note = uracil
  modified_base 191: mod_base = OTHER; note = uracil
  modified_base 195: mod_base = OTHER; note = uracil
  modified_base 196: mod_base = OTHER; note = uracil
  modified_base 203: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 211: mod_base = OTHER; note = uracil
  modified_base 220: mod_base = OTHER; note = uracil
  modified_base 226: mod_base = OTHER; note = uracil
  modified_base 237: mod_base = OTHER; note = uracil
  modified_base 243: mod_base = OTHER; note = uracil
  modified_base 244: mod_base = OTHER; note = uracil
  modified_base 268: mod_base = OTHER; note = uracil
  modified_base 269: mod_base = OTHER; note = uracil
  modified_base 279: mod_base = OTHER; note = uracil
  modified_base 280: mod_base = OTHER; note = uracil
  modified_base 282: mod_base = OTHER; note = uracil
  modified_base 285: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 299: mod_base = OTHER; note = uracil
tatggatatgaatataaatttttaaatataatattaattgtttaggtgyggtggtttatatttataatttyggtattttgggaggttaaggygggtggattatttgaggttaggagtttgagattagtttgaataaygtggtgaaatttygtttttattaaaaatataaaattagttgggtgtgatggtgtatgtttgtaattttagttatttgagaggttgaggtaggagaattgtttgaattygggaggyggaggttgaagtgagttaagattttgttattgtattttagtttgggta

SEQ ID NO: 531 - DNA, 300 bp, synthetic construct
  misc_feature 1..300: note = Synthetic polynucleotide
  source 1..300: mol_type = other DNA
  modified_base 6: mod_base = OTHER; note = uracil
  modified_base 9: mod_base = OTHER; note = uracil
  modified_base 18: mod_base = OTHER; note = uracil
  modified_base 20: mod_base = OTHER; note = uracil
  modified_base 28: mod_base = OTHER; note = uracil
  modified_base 35: mod_base = OTHER; note = uracil
  modified_base 46: mod_base = OTHER; note = uracil
  modified_base 49: mod_base = OTHER; note = uracil
  modified_base 63: mod_base = OTHER; note = uracil
  modified_base 80: mod_base = OTHER; note = uracil
  modified_base 84: mod_base = OTHER; note = uracil
  modified_base 90: mod_base = OTHER; note = uracil
  modified_base 91: mod_base = OTHER; note = uracil
  modified_base 92: mod_base = OTHER; note = uracil
  modified_base 107: mod_base = OTHER; note = uracil
  modified_base 109: mod_base = OTHER; note = uracil
  modified_base 113: mod_base = OTHER; note = uracil
  modified_base 122: mod_base = OTHER; note = uracil
  modified_base 125: mod_base = OTHER; note = uracil
  modified_base 129: mod_base = OTHER; note = uracil
  modified_base 130: mod_base = OTHER; note = uracil
  modified_base 138: mod_base = OTHER; note = uracil
  modified_base 149: mod_base = OTHER; note = uracil
  modified_base 154: mod_base = OTHER; note = uracil
  modified_base 159: mod_base = OTHER; note = uracil
  modified_base 169: mod_base = OTHER; note = uracil
  modified_base 177: mod_base = OTHER; note = uracil
  modified_base 183: mod_base = OTHER; note = uracil
  modified_base 184: mod_base = OTHER; note = uracil
  modified_base 188: mod_base = OTHER; note = uracil
  modified_base 189: mod_base = OTHER; note = uracil
  modified_base 208: mod_base = OTHER; note = uracil
  modified_base 213: mod_base = OTHER; note = uracil
  modified_base 216: mod_base = OTHER; note = uracil
  modified_base 219: mod_base = OTHER; note = uracil
  modified_base 222: mod_base = OTHER; note = uracil
  modified_base 224: mod_base = OTHER; note = uracil
  modified_base 226: mod_base = OTHER; note = uracil
  modified_base 232: mod_base = OTHER; note = uracil
  modified_base 233: mod_base = OTHER; note = uracil
  modified_base 242: mod_base = OTHER; note = uracil
  modified_base 245: mod_base = OTHER; note = uracil
  modified_base 247: mod_base = OTHER; note = uracil
  modified_base 250: mod_base = OTHER; note = uracil
  modified_base 251: mod_base = OTHER; note = uracil
  modified_base 253: mod_base = OTHER; note = uracil
  modified_base 258: mod_base = OTHER; note = uracil
  modified_base 261: mod_base = OTHER; note = uracil
  modified_base 269: mod_base = OTHER; note = uracil
  modified_base 275: mod_base = OTHER; note = uracil
  modified_base 278: mod_base = OTHER; note = uracil
  modified_base 284: mod_base = OTHER; note = uracil
  modified_base 288: mod_base = OTHER; note = uracil
  modified_base 293: mod_base = OTHER; note = uracil
  modified_base 296: mod_base = OTHER; note = uracil
  modified_base 300: mod_base = OTHER; note = uracil
tgttattttattgaatttttataatagtttaatgttatyggttttttttttaattttgggggtatagtggggagataagtaaattgatatttyggaggttgagtgatttatttatggaatgtagtaggttygtgagttaaagygagtatatggtaagatygagtgaagttggggaataatagttaagttaagagygttttaaagatatttagtatttttattatattgaattttaaggtgatagtatttttattygatagtaaaatgttagatttaattgttttttttyggtttttaaat

SEQ ID NO: 532 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 21: mod_base = OTHER; note = uracil
  modified_base 30: mod_base = OTHER; note = uracil
  modified_base 34: mod_base = OTHER; note = uracil
  modified_base 41: mod_base = OTHER; note = uracil
  modified_base 57: mod_base = OTHER; note = uracil
  modified_base 61: mod_base = OTHER; note = uracil
  modified_base 63: mod_base = OTHER; note = uracil
  modified_base 64: mod_base = OTHER; note = uracil
  modified_base 73: mod_base = OTHER; note = uracil
  modified_base 89: mod_base = OTHER; note = uracil
  modified_base 97: mod_base = OTHER; note = uracil
  modified_base 107: mod_base = OTHER; note = uracil
  modified_base 109: mod_base = OTHER; note = uracil
  modified_base 114: mod_base = OTHER; note = uracil
  modified_base 119: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 133: mod_base = OTHER; note = uracil
  modified_base 136: mod_base = OTHER; note = uracil
  modified_base 138: mod_base = OTHER; note = uracil
  modified_base 144: mod_base = OTHER; note = uracil
  modified_base 148: mod_base = OTHER; note = uracil
  modified_base 149: mod_base = OTHER; note = uracil
  modified_base 155: mod_base = OTHER; note = uracil
  modified_base 159: mod_base = OTHER; note = uracil
  modified_base 165: mod_base = OTHER; note = uracil
  modified_base 167: mod_base = OTHER; note = uracil
  modified_base 173: mod_base = OTHER; note = uracil
  modified_base 174: mod_base = OTHER; note = uracil
  modified_base 177: mod_base = OTHER; note = uracil
  modified_base 180: mod_base = OTHER; note = uracil
  modified_base 184: mod_base = OTHER; note = uracil
  modified_base 185: mod_base = OTHER; note = uracil
  modified_base 196: mod_base = OTHER; note = uracil
  modified_base 198: mod_base = OTHER; note = uracil
  modified_base 200: mod_base = OTHER; note = uracil
  modified_base 203: mod_base = OTHER; note = uracil
  modified_base 204: mod_base = OTHER; note = uracil
  modified_base 206: mod_base = OTHER; note = uracil
  modified_base 215: mod_base = OTHER; note = uracil
  modified_base 222: mod_base = OTHER; note = uracil
  modified_base 227: mod_base = OTHER; note = uracil
  modified_base 229: mod_base = OTHER; note = uracil
  modified_base 230: mod_base = OTHER; note = uracil
  modified_base 231: mod_base = OTHER; note = uracil
  modified_base 232: mod_base = OTHER; note = uracil
  modified_base 234: mod_base = OTHER; note = uracil
  modified_base 239: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 260: mod_base = OTHER; note = uracil
  modified_base 267: mod_base = OTHER; note = uracil
  modified_base 274: mod_base = OTHER; note = uracil
  modified_base 288: mod_base = OTHER; note = uracil
  modified_base 299: mod_base = OTHER; note = uracil
gtttgaagatyggaaagaaatagttgaatttgatattttgttgtygagtggaagtgttgttattttaggatttagtgtgatgaagatgttaagtatttttaaaaygtttttggtttggttattgttttttagttttattyggttttgttatgtattygttttgatttaygggtttgttgtattttatgaatgagttatttaattttyggggtattagtttgtttatttttttattatgtttttaaaattaagaagaaaatygatagtattaagttattatgagaatttaatgaagtaata

SEQ ID NO: 533 - DNA, 300 bp, synthetic construct
  misc_feature 1..300: note = Synthetic polynucleotide
  source 1..300: mol_type = other DNA
  modified_base 10: mod_base = OTHER; note = uracil
  modified_base 11: mod_base = OTHER; note = uracil
  modified_base 23: mod_base = OTHER; note = uracil
  modified_base 29: mod_base = OTHER; note = uracil
  modified_base 30: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 41: mod_base = OTHER; note = uracil
  modified_base 54: mod_base = OTHER; note = uracil
  modified_base 56: mod_base = OTHER; note = uracil
  modified_base 68: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 76: mod_base = OTHER; note = uracil
  modified_base 80: mod_base = OTHER; note = uracil
  modified_base 84: mod_base = OTHER; note = uracil
  modified_base 86: mod_base = OTHER; note = uracil
  modified_base 95: mod_base = OTHER; note = uracil
  modified_base 97: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 114: mod_base = OTHER; note = uracil
  modified_base 121: mod_base = OTHER; note = uracil
  modified_base 131: mod_base = OTHER; note = uracil
  modified_base 135: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 145: mod_base = OTHER; note = uracil
  modified_base 147: mod_base = OTHER; note = uracil
  modified_base 154: mod_base = OTHER; note = uracil
  modified_base 155: mod_base = OTHER; note = uracil
  modified_base 163: mod_base = OTHER; note = uracil
  modified_base 165: mod_base = OTHER; note = uracil
  modified_base 166: mod_base = OTHER; note = uracil
  modified_base 168: mod_base = OTHER; note = uracil
  modified_base 172: mod_base = OTHER; note = uracil
  modified_base 177: mod_base = OTHER; note = uracil
  modified_base 183: mod_base = OTHER; note = uracil
  modified_base 184: mod_base = OTHER; note = uracil
  modified_base 189: mod_base = OTHER; note = uracil
  modified_base 193: mod_base = OTHER; note = uracil
  modified_base 197: mod_base = OTHER; note = uracil
  modified_base 205: mod_base = OTHER; note = uracil
  modified_base 210: mod_base = OTHER; note = uracil
  modified_base 214: mod_base = OTHER; note = uracil
  modified_base 216: mod_base = OTHER; note = uracil
  modified_base 226: mod_base = OTHER; note = uracil
  modified_base 235: mod_base = OTHER; note = uracil
  modified_base 241: mod_base = OTHER; note = uracil
  modified_base 242: mod_base = OTHER; note = uracil
  modified_base 243: mod_base = OTHER; note = uracil
  modified_base 248: mod_base = OTHER; note = uracil
  modified_base 249: mod_base = OTHER; note = uracil
  modified_base 250: mod_base = OTHER; note = uracil
  modified_base 255: mod_base = OTHER; note = uracil
  modified_base 288: mod_base = OTHER; note = uracil
  modified_base 292: mod_base = OTHER; note = uracil
  modified_base 293: mod_base = OTHER; note = uracil
  modified_base 294: mod_base = OTHER; note = uracil
  modified_base 298: mod_base = OTHER; note = uracil
ttagtattattaaatatygagttaagggtttgattagttttaaaagaatgaggtatttttaatgtgatattatttttggtagttttaggttyggtttttttaggtttyggatgtagatggttgttaggggttggttatttttattttaayggttttggaaggtattatttttagggtatatgttatgattaatatttyggtgagtaatgttgatttaatygtagattgttattttatgtttttagtattttgtgtaggaagggaagggaaatgagtaatagatgtattagttttatttaa

SEQ ID NO: 534 - DNA, 300 bp, synthetic construct
  misc_feature 1..300: note = Synthetic polynucleotide
  source 1..300: mol_type = other DNA
  modified_base 11: mod_base = OTHER; note = uracil
  modified_base 17: mod_base = OTHER; note = uracil
  modified_base 20: mod_base = OTHER; note = uracil
  modified_base 26: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 35: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 43: mod_base = OTHER; note = uracil
  modified_base 44: mod_base = OTHER; note = uracil
  modified_base 47: mod_base = OTHER; note = uracil
  modified_base 49: mod_base = OTHER; note = uracil
  modified_base 56: mod_base = OTHER; note = uracil
  modified_base 63: mod_base = OTHER; note = uracil
  modified_base 73: mod_base = OTHER; note = uracil
  modified_base 77: mod_base = OTHER; note = uracil
  modified_base 89: mod_base = OTHER; note = uracil
  modified_base 92: mod_base = OTHER; note = uracil
  modified_base 97: mod_base = OTHER; note = uracil
  modified_base 99: mod_base = OTHER; note = uracil
  modified_base 101: mod_base = OTHER; note = uracil
  modified_base 114: mod_base = OTHER; note = uracil
  modified_base 119: mod_base = OTHER; note = uracil
  modified_base 125: mod_base = OTHER; note = uracil
  modified_base 126: mod_base = OTHER; note = uracil
  modified_base 127: mod_base = OTHER; note = uracil
  modified_base 139: mod_base = OTHER; note = uracil
  modified_base 140: mod_base = OTHER; note = uracil
  modified_base 143: mod_base = OTHER; note = uracil
  modified_base 144: mod_base = OTHER; note = uracil
  modified_base 149: mod_base = OTHER; note = uracil
  modified_base 167: mod_base = OTHER; note = uracil
  modified_base 168: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 174: mod_base = OTHER; note = uracil
  modified_base 178: mod_base = OTHER; note = uracil
  modified_base 181: mod_base = OTHER; note = uracil
  modified_base 182: mod_base = OTHER; note = uracil
  modified_base 185: mod_base = OTHER; note = uracil
  modified_base 188: mod_base = OTHER; note = uracil
  modified_base 191: mod_base = OTHER; note = uracil
  modified_base 197: mod_base = OTHER; note = uracil
  modified_base 198: mod_base = OTHER; note = uracil
  modified_base 207: mod_base = OTHER; note = uracil
  modified_base 212: mod_base = OTHER; note = uracil
  modified_base 213: mod_base = OTHER; note = uracil
  modified_base 219: mod_base = OTHER; note = uracil
  modified_base 222: mod_base = OTHER; note = uracil
  modified_base 223: mod_base = OTHER; note = uracil
  modified_base 235: mod_base = OTHER; note = uracil
  modified_base 237: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 255: mod_base = OTHER; note = uracil
  modified_base 264: mod_base = OTHER; note = uracil
  modified_base 269: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 280: mod_base = OTHER; note = uracil
  modified_base 297: mod_base = OTHER; note = uracil
ttgaatgggattgatatatttattatttattttttttttttttttgtatagggtattgggaatatgaaataatagtttaygattgagttagtattgtttatyggaatgttagttatggtatatgttttgaaagtggtgttttttaggatygttgagatgaggatggttagtttttaatagttatttgtattyggggtttgggagagtygaatttgagattgttaggaatggtgttatattaaaagtgttttatttttttggggttgattaggtttttgattygatatttggtaatattaa

SEQ ID NO: 535 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 12: mod_base = OTHER; note = uracil
  modified_base 18: mod_base = OTHER; note = uracil
  modified_base 26: mod_base = OTHER; note = uracil
  modified_base 37: mod_base = OTHER; note = uracil
  modified_base 38: mod_base = OTHER; note = uracil
  modified_base 48: mod_base = OTHER; note = uracil
  modified_base 60: mod_base = OTHER; note = uracil
  modified_base 69: mod_base = OTHER; note = uracil
  modified_base 74: mod_base = OTHER; note = uracil
  modified_base 75: mod_base = OTHER; note = uracil
  modified_base 83: mod_base = OTHER; note = uracil
  modified_base 85: mod_base = OTHER; note = uracil
  modified_base 99: mod_base = OTHER; note = uracil
  modified_base 104: mod_base = OTHER; note = uracil
  modified_base 109: mod_base = OTHER; note = uracil
  modified_base 114: mod_base = OTHER; note = uracil
  modified_base 118: mod_base = OTHER; note = uracil
  modified_base 125: mod_base = OTHER; note = uracil
  modified_base 126: mod_base = OTHER; note = uracil
  modified_base 129: mod_base = OTHER; note = uracil
  modified_base 131: mod_base = OTHER; note = uracil
  modified_base 134: mod_base = OTHER; note = uracil
  modified_base 135: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 149: mod_base = OTHER; note = uracil
  modified_base 153: mod_base = OTHER; note = uracil
  modified_base 158: mod_base = OTHER; note = uracil
  modified_base 163: mod_base = OTHER; note = uracil
  modified_base 187: mod_base = OTHER; note = uracil
  modified_base 193: mod_base = OTHER; note = uracil
  modified_base 201: mod_base = OTHER; note = uracil
  modified_base 212: mod_base = OTHER; note = uracil
  modified_base 213: mod_base = OTHER; note = uracil
  modified_base 214: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 223: mod_base = OTHER; note = uracil
  modified_base 225: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 235: mod_base = OTHER; note = uracil
  modified_base 236: mod_base = OTHER; note = uracil
  modified_base 242: mod_base = OTHER; note = uracil
  modified_base 268: mod_base = OTHER; note = uracil
  modified_base 269: mod_base = OTHER; note = uracil
  modified_base 270: mod_base = OTHER; note = uracil
  modified_base 298: mod_base = OTHER; note = uracil
agtggtggttgttgtttttyggtggtagagatgatgtttggtttatttttagtaaagtgtttaggaygttgagtttgaggggttttggaatggaaaaataaaataaaataaaataaatyggaggttygttttgtttggtttttagagataygtaaagttgggtaaaggaaggagattgaggtgggattgagatattgttgtattgtgaatgtttyggttttttattttttgtttttygaattatgattgttttatgyggttatttttttttttggtgaggaaaatgggatgtggtgttaa

SEQ ID NO: 536 - DNA, 300 bp, synthetic construct
  misc_feature 1..300: note = Synthetic polynucleotide
  source 1..300: mol_type = other DNA
  modified_base 5: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 13: mod_base = OTHER; note = uracil
  modified_base 14: mod_base = OTHER; note = uracil
  modified_base 15: mod_base = OTHER; note = uracil
  modified_base 21: mod_base = OTHER; note = uracil
  modified_base 22: mod_base = OTHER; note = uracil
  modified_base 24: mod_base = OTHER; note = uracil
  modified_base 26: mod_base = OTHER; note = uracil
  modified_base 27: mod_base = OTHER; note = uracil
  modified_base 42: mod_base = OTHER; note = uracil
  modified_base 45: mod_base = OTHER; note = uracil
  modified_base 52: mod_base = OTHER; note = uracil
  modified_base 56: mod_base = OTHER; note = uracil
  modified_base 70: mod_base = OTHER; note = uracil
  modified_base 84: mod_base = OTHER; note = uracil
  modified_base 90: mod_base = OTHER; note = uracil
  modified_base 94: mod_base = OTHER; note = uracil
  modified_base 96: mod_base = OTHER; note = uracil
  modified_base 101: mod_base = OTHER; note = uracil
  modified_base 104: mod_base = OTHER; note = uracil
  modified_base 110: mod_base = OTHER; note = uracil
  modified_base 112: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 120: mod_base = OTHER; note = uracil
  modified_base 121: mod_base = OTHER; note = uracil
  modified_base 123: mod_base = OTHER; note = uracil
  modified_base 127: mod_base = OTHER; note = uracil
  modified_base 129: mod_base = OTHER; note = uracil
  modified_base 130: mod_base = OTHER; note = uracil
  modified_base 133: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 144: mod_base = OTHER; note = uracil
  modified_base 154: mod_base = OTHER; note = uracil
  modified_base 156: mod_base = OTHER; note = uracil
  modified_base 163: mod_base = OTHER; note = uracil
  modified_base 164: mod_base = OTHER; note = uracil
  modified_base 168: mod_base = OTHER; note = uracil
  modified_base 177: mod_base = OTHER; note = uracil
  modified_base 178: mod_base = OTHER; note = uracil
  modified_base 180: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 214: mod_base = OTHER; note = uracil
  modified_base 219: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 228: mod_base = OTHER; note = uracil
  modified_base 230: mod_base = OTHER; note = uracil
  modified_base 236: mod_base = OTHER; note = uracil
  modified_base 237: mod_base = OTHER; note = uracil
  modified_base 242: mod_base = OTHER; note = uracil
  modified_base 244: mod_base = OTHER; note = uracil
  modified_base 249: mod_base = OTHER; note = uracil
  modified_base 260: mod_base = OTHER; note = uracil
  modified_base 261: mod_base = OTHER; note = uracil
  modified_base 265: mod_base = OTHER; note = uracil
  modified_base 268: mod_base = OTHER; note = uracil
  modified_base 271: mod_base = OTHER; note = uracil
  modified_base 273: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 287: mod_base = OTHER; note = uracil
  modified_base 290: mod_base = OTHER; note = uracil
  modified_base 293: mod_base = OTHER; note = uracil
  modified_base 294: mod_base = OTHER; note = uracil
  modified_base 296: mod_base = OTHER; note = uracil
  modified_base 297: mod_base = OTHER; note = uracil
  modified_base 299: mod_base = OTHER; note = uracil
ttgatattatattttattttttttattaaagggaaaaataatygtataaaataattatgattyggggggtaggaggtggggaatyggggtatttataatgtaataatgttttagttttattttaattttttttttttgtttagttttgygtgtttttaggagttaggtagagygggttttyggtttgttttgttttgttttgtttttttattttagagttttttaggtttagygttttaagtattttattaagaataaattaggtattatttttgttatygagaaatagtagttattatt

SEQ ID NO: 537 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 15: mod_base = OTHER; note = uracil
  modified_base 21: mod_base = OTHER; note = uracil
  modified_base 23: mod_base = OTHER; note = uracil
  modified_base 32: mod_base = OTHER; note = uracil
  modified_base 33: mod_base = OTHER; note = uracil
  modified_base 36: mod_base = OTHER; note = uracil
  modified_base 42: mod_base = OTHER; note = uracil
  modified_base 45: mod_base = OTHER; note = uracil
  modified_base 50: mod_base = OTHER; note = uracil
  modified_base 52: mod_base = OTHER; note = uracil
  modified_base 54: mod_base = OTHER; note = uracil
  modified_base 57: mod_base = OTHER; note = uracil
  modified_base 61: mod_base = OTHER; note = uracil
  modified_base 65: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 75: mod_base = OTHER; note = uracil
  modified_base 83: mod_base = OTHER; note = uracil
  modified_base 88: mod_base = OTHER; note = uracil
  modified_base 90: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 102: mod_base = OTHER; note = uracil
  modified_base 110: mod_base = OTHER; note = uracil
  modified_base 111: mod_base = OTHER; note = uracil
  modified_base 113: mod_base = OTHER; note = uracil
  modified_base 115: mod_base = OTHER; note = uracil
  modified_base 116: mod_base = OTHER; note = uracil
  modified_base 117: mod_base = OTHER; note = uracil
  modified_base 122: mod_base = OTHER; note = uracil
  modified_base 124: mod_base = OTHER; note = uracil
  modified_base 126: mod_base = OTHER; note = uracil
  modified_base 131: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 141: mod_base = OTHER; note = uracil
  modified_base 142: mod_base = OTHER; note = uracil
  modified_base 145: mod_base = OTHER; note = uracil
  modified_base 148: mod_base = OTHER; note = uracil
  modified_base 149: mod_base = OTHER; note = uracil
  modified_base 154: mod_base = OTHER; note = uracil
  modified_base 157: mod_base = OTHER; note = uracil
  modified_base 161: mod_base = OTHER; note = uracil
  modified_base 172: mod_base = OTHER; note = uracil
  modified_base 211: mod_base = OTHER; note = uracil
  modified_base 222: mod_base = OTHER; note = uracil
  modified_base 227: mod_base = OTHER; note = uracil
  modified_base 231: mod_base = OTHER; note = uracil
  modified_base 232: mod_base = OTHER; note = uracil
  modified_base 233: mod_base = OTHER; note = uracil
  modified_base 234: mod_base = OTHER; note = uracil
  modified_base 237: mod_base = OTHER; note = uracil
  modified_base 238: mod_base = OTHER; note = uracil
  modified_base 239: mod_base = OTHER; note = uracil
  modified_base 240: mod_base = OTHER; note = uracil
  modified_base 251: mod_base = OTHER; note = uracil
  modified_base 253: mod_base = OTHER; note = uracil
  modified_base 258: mod_base = OTHER; note = uracil
  modified_base 259: mod_base = OTHER; note = uracil
  modified_base 260: mod_base = OTHER; note = uracil
  modified_base 264: mod_base = OTHER; note = uracil
  modified_base 276: mod_base = OTHER; note = uracil
  modified_base 278: mod_base = OTHER; note = uracil
  modified_base 285: mod_base = OTHER; note = uracil
  modified_base 288: mod_base = OTHER; note = uracil
  modified_base 290: mod_base = OTHER; note = uracil
  modified_base 291: mod_base = OTHER; note = uracil
  modified_base 293: mod_base = OTHER; note = uracil
  modified_base 294: mod_base = OTHER; note = uracil
  modified_base 295: mod_base = OTHER; note = uracil
  modified_base 296: mod_base = OTHER; note = uracil
ggggtyggtatgggttggagtttagagayggttagttaggattttaggatatatagtaaattagttgygtttygttgagggttagygtatagtygtttatataaggtgtttttttttygggttttttgggtygtyggttttttgtttttygtgtygtagatygggattagattgtggaygyggggaaggaagggggygttgygaygggattttgaggggagtaggatttgtttttgtttttgyggygaagttttaggttttggtaaggttyggtatatygggggtygtttttttttaggg

SEQ ID NO: 538 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 2: mod_base = OTHER; note = uracil
  modified_base 3: mod_base = OTHER; note = uracil
  modified_base 17: mod_base = OTHER; note = uracil
  modified_base 18: mod_base = OTHER; note = uracil
  modified_base 19: mod_base = OTHER; note = uracil
  modified_base 20: mod_base = OTHER; note = uracil
  modified_base 28: mod_base = OTHER; note = uracil
  modified_base 33: mod_base = OTHER; note = uracil
  modified_base 34: mod_base = OTHER; note = uracil
  modified_base 38: mod_base = OTHER; note = uracil
  modified_base 39: mod_base = OTHER; note = uracil
  modified_base 44: mod_base = OTHER; note = uracil
  modified_base 45: mod_base = OTHER; note = uracil
  modified_base 51: mod_base = OTHER; note = uracil
  modified_base 56: mod_base = OTHER; note = uracil
  modified_base 59: mod_base = OTHER; note = uracil
  modified_base 65: mod_base = OTHER; note = uracil
  modified_base 71: mod_base = OTHER; note = uracil
  modified_base 76: mod_base = OTHER; note = uracil
  modified_base 77: mod_base = OTHER; note = uracil
  modified_base 80: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 87: mod_base = OTHER; note = uracil
  modified_base 93: mod_base = OTHER; note = uracil
  modified_base 94: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 109: mod_base = OTHER; note = uracil
  modified_base 112: mod_base = OTHER; note = uracil
  modified_base 113: mod_base = OTHER; note = uracil
  modified_base 116: mod_base = OTHER; note = uracil
  modified_base 117: mod_base = OTHER; note = uracil
  modified_base 118: mod_base = OTHER; note = uracil
  modified_base 124: mod_base = OTHER; note = uracil
  modified_base 125: mod_base = OTHER; note = uracil
  modified_base 127: mod_base = OTHER; note = uracil
  modified_base 131: mod_base = OTHER; note = uracil
  modified_base 136: mod_base = OTHER; note = uracil
  modified_base 137: mod_base = OTHER; note = uracil
  modified_base 142: mod_base = OTHER; note = uracil
  modified_base 148: mod_base = OTHER; note = uracil
  modified_base 157: mod_base = OTHER; note = uracil
  modified_base 164: mod_base = OTHER; note = uracil
  modified_base 171: mod_base = OTHER; note = uracil
  modified_base 172: mod_base = OTHER; note = uracil
  modified_base 173: mod_base = OTHER; note = uracil
  modified_base 180: mod_base = OTHER; note = uracil
  modified_base 181: mod_base = OTHER; note = uracil
  modified_base 193: mod_base = OTHER; note = uracil
  modified_base 195: mod_base = OTHER; note = uracil
  modified_base 196: mod_base = OTHER; note = uracil
  modified_base 209: mod_base = OTHER; note = uracil
  modified_base 216: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 224: mod_base = OTHER; note = uracil
  modified_base 234: mod_base = OTHER; note = uracil
  modified_base 237: mod_base = OTHER; note = uracil
  modified_base 245: mod_base = OTHER; note = uracil
  modified_base 253: mod_base = OTHER; note = uracil
  modified_base 254: mod_base = OTHER; note = uracil
  modified_base 261: mod_base = OTHER; note = uracil
  modified_base 262: mod_base = OTHER; note = uracil
  modified_base 266: mod_base = OTHER; note = uracil
  modified_base 270: mod_base = OTHER; note = uracil
  modified_base 274: mod_base = OTHER; note = uracil
  modified_base 276: mod_base = OTHER; note = uracil
  modified_base 281: mod_base = OTHER; note = uracil
  modified_base 283: mod_base = OTHER; note = uracil
  modified_base 284: mod_base = OTHER; note = uracil
  modified_base 287: mod_base = OTHER; note = uracil
  modified_base 288: mod_base = OTHER; note = uracil
  modified_base 289: mod_base = OTHER; note = uracil
  modified_base 293: mod_base = OTHER; note = uracil
  modified_base 297: mod_base = OTHER; note = uracil
  modified_base 298: mod_base = OTHER; note = uracil
  modified_base 299: mod_base = OTHER; note = uracil
  modified_base 300: mod_base = OTHER; note = uracil
ttttggggaggagyggttttyggtgtatygaattttgttagggtttagagtttygtygtaggggtaggggtaagttttgttttttttaagatttygtygtaaygttttttttttttttygygtttatagtttaatttyggtttgyggtaygggaagtaggaggtyggyggtttagagagttyggggagaggatattttgtgtgggyggttgtgygttgatttttagyggggygtagttagtttgttgtgtgttttgaagttttagttggtygtttttgagttttagtttatgtygatttt

SEQ ID NO: 539 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 8: mod_base = OTHER; note = uracil
  modified_base 18: mod_base = OTHER; note = uracil
  modified_base 19: mod_base = OTHER; note = uracil
  modified_base 21: mod_base = OTHER; note = uracil
  modified_base 23: mod_base = OTHER; note = uracil
  modified_base 39: mod_base = OTHER; note = uracil
  modified_base 50: mod_base = OTHER; note = uracil
  modified_base 57: mod_base = OTHER; note = uracil
  modified_base 58: mod_base = OTHER; note = uracil
  modified_base 60: mod_base = OTHER; note = uracil
  modified_base 64: mod_base = OTHER; note = uracil
  modified_base 65: mod_base = OTHER; note = uracil
  modified_base 70: mod_base = OTHER; note = uracil
  modified_base 78: mod_base = OTHER; note = uracil
  modified_base 80: mod_base = OTHER; note = uracil
  modified_base 89: mod_base = OTHER; note = uracil
  modified_base 96: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 107: mod_base = OTHER; note = uracil
  modified_base 128: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 154: mod_base = OTHER; note = uracil
  modified_base 155: mod_base = OTHER; note = uracil
  modified_base 158: mod_base = OTHER; note = uracil
  modified_base 159: mod_base = OTHER; note = uracil
  modified_base 162: mod_base = OTHER; note = uracil
  modified_base 164: mod_base = OTHER; note = uracil
  modified_base 166: mod_base = OTHER; note = uracil
  modified_base 167: mod_base = OTHER; note = uracil
  modified_base 169: mod_base = OTHER; note = uracil
  modified_base 171: mod_base = OTHER; note = uracil
  modified_base 173: mod_base = OTHER; note = uracil
  modified_base 176: mod_base = OTHER; note = uracil
  modified_base 181: mod_base = OTHER; note = uracil
  modified_base 186: mod_base = OTHER; note = uracil
  modified_base 187: mod_base = OTHER; note = uracil
  modified_base 189: mod_base = OTHER; note = uracil
  modified_base 196: mod_base = OTHER; note = uracil
  modified_base 201: mod_base = OTHER; note = uracil
  modified_base 202: mod_base = OTHER; note = uracil
  modified_base 205: mod_base = OTHER; note = uracil
  modified_base 210: mod_base = OTHER; note = uracil
  modified_base 214: mod_base = OTHER; note = uracil
  modified_base 215: mod_base = OTHER; note = uracil
  modified_base 227: mod_base = OTHER; note = uracil
  modified_base 230: mod_base = OTHER; note = uracil
  modified_base 233: mod_base = OTHER; note = uracil
  modified_base 248: mod_base = OTHER; note = uracil
  modified_base 265: mod_base = OTHER; note = uracil
  modified_base 270: mod_base = OTHER; note = uracil
  modified_base 271: mod_base = OTHER; note = uracil
  modified_base 272: mod_base = OTHER; note = uracil
  modified_base 279: mod_base = OTHER; note = uracil
  modified_base 280: mod_base = OTHER; note = uracil
  modified_base 284: mod_base = OTHER; note = uracil
  modified_base 285: mod_base = OTHER; note = uracil
  modified_base 293: mod_base = OTHER; note = uracil
  modified_base 300: mod_base = OTHER; note = uracil
gtgtaygtagggaaatattttatagggtaaatttggattygattgagaataggaagttataggttaatataaggaggttttgtgagaatagatgataaattataagtyggggagggggaggaaagagttttttgggtttgggggatgggygagttygttagtatattatatatagttgygtttggttttagtaattaaaattattattatagatttgayggtttggttgtagttgtaaagagataagtatgttggaagagaaaatagggtttyggtgattyggttttagggtttgagygt

SEQ ID NO: 540 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 5: mod_base = OTHER; note = uracil
  modified_base 9: mod_base = OTHER; note = uracil
  modified_base 10: mod_base = OTHER; note = uracil
  modified_base 11: mod_base = OTHER; note = uracil
  modified_base 17: mod_base = OTHER; note = uracil
  modified_base 23: mod_base = OTHER; note = uracil
  modified_base 25: mod_base = OTHER; note = uracil
  modified_base 31: mod_base = OTHER; note = uracil
  modified_base 32: mod_base = OTHER; note = uracil
  modified_base 33: mod_base = OTHER; note = uracil
  modified_base 40: mod_base = OTHER; note = uracil
  modified_base 42: mod_base = OTHER; note = uracil
  modified_base 45: mod_base = OTHER; note = uracil
  modified_base 46: mod_base = OTHER; note = uracil
  modified_base 49: mod_base = OTHER; note = uracil
  modified_base 53: mod_base = OTHER; note = uracil
  modified_base 58: mod_base = OTHER; note = uracil
  modified_base 60: mod_base = OTHER; note = uracil
  modified_base 65: mod_base = OTHER; note = uracil
  modified_base 68: mod_base = OTHER; note = uracil
  modified_base 71: mod_base = OTHER; note = uracil
  modified_base 74: mod_base = OTHER; note = uracil
  modified_base 75: mod_base = OTHER; note = uracil
  modified_base 79: mod_base = OTHER; note = uracil
  modified_base 83: mod_base = OTHER; note = uracil
  modified_base 88: mod_base = OTHER; note = uracil
  modified_base 109: mod_base = OTHER; note = uracil
  modified_base 115: mod_base = OTHER; note = uracil
  modified_base 116: mod_base = OTHER; note = uracil
  modified_base 122: mod_base = OTHER; note = uracil
  modified_base 125: mod_base = OTHER; note = uracil
  modified_base 139: mod_base = OTHER; note = uracil
  modified_base 147: mod_base = OTHER; note = uracil
  modified_base 151: mod_base = OTHER; note = uracil
  modified_base 152: mod_base = OTHER; note = uracil
  modified_base 153: mod_base = OTHER; note = uracil
  modified_base 156: mod_base = OTHER; note = uracil
  modified_base 157: mod_base = OTHER; note = uracil
  modified_base 158: mod_base = OTHER; note = uracil
  modified_base 159: mod_base = OTHER; note = uracil
  modified_base 160: mod_base = OTHER; note = uracil
  modified_base 164: mod_base = OTHER; note = uracil
  modified_base 165: mod_base = OTHER; note = uracil
  modified_base 166: mod_base = OTHER; note = uracil
  modified_base 173: mod_base = OTHER; note = uracil
  modified_base 175: mod_base = OTHER; note = uracil
  modified_base 179: mod_base = OTHER; note = uracil
  modified_base 180: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 185: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 194: mod_base = OTHER; note = uracil
  modified_base 206: mod_base = OTHER; note = uracil
  modified_base 209: mod_base = OTHER; note = uracil
  modified_base 214: mod_base = OTHER; note = uracil
  modified_base 216: mod_base = OTHER; note = uracil
  modified_base 218: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 227: mod_base = OTHER; note = uracil
  modified_base 237: mod_base = OTHER; note = uracil
  modified_base 238: mod_base = OTHER; note = uracil
  modified_base 244: mod_base = OTHER; note = uracil
  modified_base 247: mod_base = OTHER; note = uracil
  modified_base 248: mod_base = OTHER; note = uracil
  modified_base 253: mod_base = OTHER; note = uracil
  modified_base 255: mod_base = OTHER; note = uracil
  modified_base 264: mod_base = OTHER; note = uracil
  modified_base 265: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 288: mod_base = OTHER; note = uracil
  modified_base 289: mod_base = OTHER; note = uracil
  modified_base 290: mod_base = OTHER; note = uracil
  modified_base 297: mod_base = OTHER; note = uracil
  modified_base 299: mod_base = OTHER; note = uracil
ygtttagattttaaggtygggttatyggggttttgtttttttttttaatatgtttatttttttatagttgtagttaaatygttaggtttgtaatgatggttttgattattgaggttaagygtagttgtgtgtggtgtgttggygggttygtttattttttaggtttagaaagttttttttttttttttttyggtttgtggtttgttatttgtttttatagagtttttttgtattggtttgtggttttttgtttttaatyggatttaaatttattttgtgaggtatttttttgygtgtata

SEQ ID NO: 541 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 25: mod_base = OTHER; note = uracil
  modified_base 37: mod_base = OTHER; note = uracil
  modified_base 40: mod_base = OTHER; note = uracil
  modified_base 52: mod_base = OTHER; note = uracil
  modified_base 54: mod_base = OTHER; note = uracil
  modified_base 56: mod_base = OTHER; note = uracil
  modified_base 58: mod_base = OTHER; note = uracil
  modified_base 60: mod_base = OTHER; note = uracil
  modified_base 62: mod_base = OTHER; note = uracil
  modified_base 72: mod_base = OTHER; note = uracil
  modified_base 74: mod_base = OTHER; note = uracil
  modified_base 77: mod_base = OTHER; note = uracil
  modified_base 78: mod_base = OTHER; note = uracil
  modified_base 87: mod_base = OTHER; note = uracil
  modified_base 106: mod_base = OTHER; note = uracil
  modified_base 109: mod_base = OTHER; note = uracil
  modified_base 112: mod_base = OTHER; note = uracil
  modified_base 115: mod_base = OTHER; note = uracil
  modified_base 121: mod_base = OTHER; note = uracil
  modified_base 123: mod_base = OTHER; note = uracil
  modified_base 127: mod_base = OTHER; note = uracil
  modified_base 129: mod_base = OTHER; note = uracil
  modified_base 131: mod_base = OTHER; note = uracil
  modified_base 132: mod_base = OTHER; note = uracil
  modified_base 134: mod_base = OTHER; note = uracil
  modified_base 138: mod_base = OTHER; note = uracil
  modified_base 139: mod_base = OTHER; note = uracil
  modified_base 143: mod_base = OTHER; note = uracil
  modified_base 144: mod_base = OTHER; note = uracil
  modified_base 148: mod_base = OTHER; note = uracil
  modified_base 171: mod_base = OTHER; note = uracil
  modified_base 172: mod_base = OTHER; note = uracil
  modified_base 176: mod_base = OTHER; note = uracil
  modified_base 181: mod_base = OTHER; note = uracil
  modified_base 182: mod_base = OTHER; note = uracil
  modified_base 186: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 196: mod_base = OTHER; note = uracil
  modified_base 198: mod_base = OTHER; note = uracil
  modified_base 239: mod_base = OTHER; note = uracil
  modified_base 254: mod_base = OTHER; note = uracil
  modified_base 255: mod_base = OTHER; note = uracil
  modified_base 266: mod_base = OTHER; note = uracil
  modified_base 268: mod_base = OTHER; note = uracil
  modified_base 275: mod_base = OTHER; note = uracil
  modified_base 293: mod_base = OTHER; note = uracil
  modified_base 294: mod_base = OTHER; note = uracil
  modified_base 297: mod_base = OTHER; note = uracil
tgtgygggtagtgggttgtgygggtagtgggttgtgtattyggatgtgtagtatttatatatttygggtgattttttttgggtaagttgtggatgtgagtgggggtagtatttgtygtgatttatttttttttttttttattttaagtygggtgggggagtttgggatttttagataaggtttggttttttttggtatagagggtgggagtggggatggggagggaggagggaagggttatgggaaggtggggttatgttttgtgtttaatgaattgagaagggggagggttttagttgg

SEQ ID NO: 542 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 4: mod_base = OTHER; note = uracil
  modified_base 10: mod_base = OTHER; note = uracil
  modified_base 11: mod_base = OTHER; note = uracil
  modified_base 12: mod_base = OTHER; note = uracil
  modified_base 14: mod_base = OTHER; note = uracil
  modified_base 15: mod_base = OTHER; note = uracil
  modified_base 16: mod_base = OTHER; note = uracil
  modified_base 17: mod_base = OTHER; note = uracil
  modified_base 18: mod_base = OTHER; note = uracil
  modified_base 21: mod_base = OTHER; note = uracil
  modified_base 23: mod_base = OTHER; note = uracil
  modified_base 28: mod_base = OTHER; note = uracil
  modified_base 35: mod_base = OTHER; note = uracil
  modified_base 37: mod_base = OTHER; note = uracil
  modified_base 42: mod_base = OTHER; note = uracil
  modified_base 47: mod_base = OTHER; note = uracil
  modified_base 48: mod_base = OTHER; note = uracil
  modified_base 49: mod_base = OTHER; note = uracil
  modified_base 50: mod_base = OTHER; note = uracil
  modified_base 52: mod_base = OTHER; note = uracil
  modified_base 53: mod_base = OTHER; note = uracil
  modified_base 56: mod_base = OTHER; note = uracil
  modified_base 57: mod_base = OTHER; note = uracil
  modified_base 58: mod_base = OTHER; note = uracil
  modified_base 63: mod_base = OTHER; note = uracil
  modified_base 64: mod_base = OTHER; note = uracil
  modified_base 65: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 72: mod_base = OTHER; note = uracil
  modified_base 73: mod_base = OTHER; note = uracil
  modified_base 75: mod_base = OTHER; note = uracil
  modified_base 76: mod_base = OTHER; note = uracil
  modified_base 77: mod_base = OTHER; note = uracil
  modified_base 79: mod_base = OTHER; note = uracil
  modified_base 80: mod_base = OTHER; note = uracil
  modified_base 81: mod_base = OTHER; note = uracil
  modified_base 82: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 88: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 96: mod_base = OTHER; note = uracil
  modified_base 97: mod_base = OTHER; note = uracil
  modified_base 98: mod_base = OTHER; note = uracil
  modified_base 100: mod_base = OTHER; note = uracil
  modified_base 105: mod_base = OTHER; note = uracil
  modified_base 106: mod_base = OTHER; note = uracil
  modified_base 115: mod_base = OTHER; note = uracil
  modified_base 116: mod_base = OTHER; note = uracil
  modified_base 120: mod_base = OTHER; note = uracil
  modified_base 121: mod_base = OTHER; note = uracil
  modified_base 126: mod_base = OTHER; note = uracil
  modified_base 134: mod_base = OTHER; note = uracil
  modified_base 135: mod_base = OTHER; note = uracil
  modified_base 136: mod_base = OTHER; note = uracil
  modified_base 140: mod_base = OTHER; note = uracil
  modified_base 142: mod_base = OTHER; note = uracil
  modified_base 143: mod_base = OTHER; note = uracil
  modified_base 144: mod_base = OTHER; note = uracil
  modified_base 145: mod_base = OTHER; note = uracil
  modified_base 146: mod_base = OTHER; note = uracil
  modified_base 148: mod_base = OTHER; note = uracil
  modified_base 149: mod_base = OTHER; note = uracil
  modified_base 153: mod_base = OTHER; note = uracil
  modified_base 181: mod_base = OTHER; note = uracil
  modified_base 186: mod_base = OTHER; note = uracil
  modified_base 192: mod_base = OTHER; note = uracil
  modified_base 195: mod_base = OTHER; note = uracil
  modified_base 196: mod_base = OTHER; note = uracil
  modified_base 197: mod_base = OTHER; note = uracil
  modified_base 198: mod_base = OTHER; note = uracil
  modified_base 199: mod_base = OTHER; note = uracil
  modified_base 201: mod_base = OTHER; note = uracil
  modified_base 203: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 211: mod_base = OTHER; note = uracil
  modified_base 214: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 230: mod_base = OTHER; note = uracil
  modified_base 232: mod_base = OTHER; note = uracil
  modified_base 233: mod_base = OTHER; note = uracil
  modified_base 249: mod_base = OTHER; note = uracil
  modified_base 252: mod_base = OTHER; note = uracil
  modified_base 254: mod_base = OTHER; note = uracil
  modified_base 257: mod_base = OTHER; note = uracil
  modified_base 264: mod_base = OTHER; note = uracil
  modified_base 266: mod_base = OTHER; note = uracil
  modified_base 269: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 276: mod_base = OTHER; note = uracil
  modified_base 277: mod_base = OTHER; note = uracil
  modified_base 280: mod_base = OTHER; note = uracil
  modified_base 282: mod_base = OTHER; note = uracil
  modified_base 285: mod_base = OTHER; note = uracil
  modified_base 286: mod_base = OTHER; note = uracil
  modified_base 287: mod_base = OTHER; note = uracil
  modified_base 289: mod_base = OTHER; note = uracil
  modified_base 292: mod_base = OTHER; note = uracil
  modified_base 293: mod_base = OTHER; note = uracil
  modified_base 296: mod_base = OTHER; note = uracil
  modified_base 298: mod_base = OTHER; note = uracil
tagttggaattttttttttttttagtttattgagtataaaatatggttttatttttttatgattttttttttttttttttttatttttatttttattttttgtgttagggggagttaggttttgtttggaaattttaaatttttttattyggtttggaatggaaagaggagagaatgagttayggtagatgttgtttttatttatatttatagtttatttaggaagagttattygaagtgtgtgagtgttatatattyggatgtataatttattgttygtataatttattgttygtataa

SEQ ID NO: 543 - DNA, 300 bp, synthetic construct
  misc_feature 1..300: note = Synthetic polynucleotide
  source 1..300: mol_type = other DNA
  modified_base 2: mod_base = OTHER; note = uracil
  modified_base 5: mod_base = OTHER; note = uracil
  modified_base 11: mod_base = OTHER; note = uracil
  modified_base 20: mod_base = OTHER; note = uracil
  modified_base 25: mod_base = OTHER; note = uracil
  modified_base 35: mod_base = OTHER; note = uracil
  modified_base 38: mod_base = OTHER; note = uracil
  modified_base 60: mod_base = OTHER; note = uracil
  modified_base 61: mod_base = OTHER; note = uracil
  modified_base 70: mod_base = OTHER; note = uracil
  modified_base 76: mod_base = OTHER; note = uracil
  modified_base 77: mod_base = OTHER; note = uracil
  modified_base 86: mod_base = OTHER; note = uracil
  modified_base 113: mod_base = OTHER; note = uracil
  modified_base 122: mod_base = OTHER; note = uracil
  modified_base 147: mod_base = OTHER; note = uracil
  modified_base 148: mod_base = OTHER; note = uracil
  modified_base 150: mod_base = OTHER; note = uracil
  modified_base 156: mod_base = OTHER; note = uracil
  modified_base 162: mod_base = OTHER; note = uracil
  modified_base 167: mod_base = OTHER; note = uracil
  modified_base 177: mod_base = OTHER; note = uracil
  modified_base 178: mod_base = OTHER; note = uracil
  modified_base 179: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 198: mod_base = OTHER; note = uracil
  modified_base 199: mod_base = OTHER; note = uracil
  modified_base 200: mod_base = OTHER; note = uracil
  modified_base 205: mod_base = OTHER; note = uracil
  modified_base 206: mod_base = OTHER; note = uracil
  modified_base 207: mod_base = OTHER; note = uracil
  modified_base 214: mod_base = OTHER; note = uracil
  modified_base 215: mod_base = OTHER; note = uracil
  modified_base 217: mod_base = OTHER; note = uracil
  modified_base 220: mod_base = OTHER; note = uracil
  modified_base 221: mod_base = OTHER; note = uracil
  modified_base 224: mod_base = OTHER; note = uracil
  modified_base 228: mod_base = OTHER; note = uracil
  modified_base 238: mod_base = OTHER; note = uracil
  modified_base 240: mod_base = OTHER; note = uracil
  modified_base 252: mod_base = OTHER; note = uracil
  modified_base 253: mod_base = OTHER; note = uracil
  modified_base 266: mod_base = OTHER; note = uracil
  modified_base 267: mod_base = OTHER; note = uracil
  modified_base 268: mod_base = OTHER; note = uracil
  modified_base 270: mod_base = OTHER; note = uracil
  modified_base 271: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 279: mod_base = OTHER; note = uracil
  modified_base 280: mod_base = OTHER; note = uracil
  modified_base 283: mod_base = OTHER; note = uracil
  modified_base 297: mod_base = OTHER; note = uracil
  modified_base 300: mod_base = OTHER; note = uracil
gtaattggygttgggtaggtaaagtygggagaaattgttgagaygaggttaggatttaatttttaaattttggagttatyggaaatygaggggaggaygaygggtgtyggtgttaatgaggttgggggygggygatgygyggtgggttttygagttyggggtaggtttygggggtttttyggggaaggttttgggagtttttggttttggyggttttygttattagattgggaatgtttttgattgggtggttaggaggyggtggttttttttttygtttagttgaggggtgtygttttt

SEQ ID NO: 544 - DNA, 300 bp, synthetic construct
  misc_feature 1..300: note = Synthetic polynucleotide
  source 1..300: mol_type = other DNA
  modified_base 9: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 14: mod_base = OTHER; note = uracil
  modified_base 16: mod_base = OTHER; note = uracil
  modified_base 19: mod_base = OTHER; note = uracil
  modified_base 36: mod_base = OTHER; note = uracil
  modified_base 37: mod_base = OTHER; note = uracil
  modified_base 39: mod_base = OTHER; note = uracil
  modified_base 42: mod_base = OTHER; note = uracil
  modified_base 43: mod_base = OTHER; note = uracil
  modified_base 45: mod_base = OTHER; note = uracil
  modified_base 46: mod_base = OTHER; note = uracil
  modified_base 50: mod_base = OTHER; note = uracil
  modified_base 51: mod_base = OTHER; note = uracil
  modified_base 53: mod_base = OTHER; note = uracil
  modified_base 54: mod_base = OTHER; note = uracil
  modified_base 55: mod_base = OTHER; note = uracil
  modified_base 59: mod_base = OTHER; note = uracil
  modified_base 65: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 75: mod_base = OTHER; note = uracil
  modified_base 88: mod_base = OTHER; note = uracil
  modified_base 91: mod_base = OTHER; note = uracil
  modified_base 92: mod_base = OTHER; note = uracil
  modified_base 97: mod_base = OTHER; note = uracil
  modified_base 98: mod_base = OTHER; note = uracil
  modified_base 104: mod_base = OTHER; note = uracil
  modified_base 106: mod_base = OTHER; note = uracil
  modified_base 107: mod_base = OTHER; note = uracil
  modified_base 108: mod_base = OTHER; note = uracil
  modified_base 113: mod_base = OTHER; note = uracil
  modified_base 114: mod_base = OTHER; note = uracil
  modified_base 117: mod_base = OTHER; note = uracil
  modified_base 118: mod_base = OTHER; note = uracil
  modified_base 119: mod_base = OTHER; note = uracil
  modified_base 127: mod_base = OTHER; note = uracil
  modified_base 128: mod_base = OTHER; note = uracil
  modified_base 129: mod_base = OTHER; note = uracil
  modified_base 130: mod_base = OTHER; note = uracil
  modified_base 136: mod_base = OTHER; note = uracil
  modified_base 137: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 147: mod_base = OTHER; note = uracil
  modified_base 155: mod_base = OTHER; note = uracil
  modified_base 156: mod_base = OTHER; note = uracil
  modified_base 157: mod_base = OTHER; note = uracil
  modified_base 159: mod_base = OTHER; note = uracil
  modified_base 164: mod_base = OTHER; note = uracil
  modified_base 169: mod_base = OTHER; note = uracil
  modified_base 170: mod_base = OTHER; note = uracil
  modified_base 173: mod_base = OTHER; note = uracil
  modified_base 174: mod_base = OTHER; note = uracil
  modified_base 175: mod_base = OTHER; note = uracil
  modified_base 176: mod_base = OTHER; note = uracil
  modified_base 177: mod_base = OTHER; note = uracil
  modified_base 180: mod_base = OTHER; note = uracil
  modified_base 181: mod_base = OTHER; note = uracil
  modified_base 183: mod_base = OTHER; note = uracil
  modified_base 189: mod_base = OTHER; note = uracil
  modified_base 191: mod_base = OTHER; note = uracil
  modified_base 195: mod_base = OTHER; note = uracil
  modified_base 197: mod_base = OTHER; note = uracil
  modified_base 198: mod_base = OTHER; note = uracil
  modified_base 205: mod_base = OTHER; note = uracil
  modified_base 206: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 219: mod_base = OTHER; note = uracil
  modified_base 226: mod_base = OTHER; note = uracil
  modified_base 228: mod_base = OTHER; note = uracil
  modified_base 229: mod_base = OTHER; note = uracil
  modified_base 248: mod_base = OTHER; note = uracil
  modified_base 249: mod_base = OTHER; note = uracil
  modified_base 253: mod_base = OTHER; note = uracil
  modified_base 254: mod_base = OTHER; note = uracil
  modified_base 259: mod_base = OTHER; note = uracil
  modified_base 261: mod_base = OTHER; note = uracil
  modified_base 264: mod_base = OTHER; note = uracil
  modified_base 270: mod_base = OTHER; note = uracil
  modified_base 272: mod_base = OTHER; note = uracil
  modified_base 273: mod_base = OTHER; note = uracil
  modified_base 277: mod_base = OTHER; note = uracil
  modified_base 282: mod_base = OTHER; note = uracil
  modified_base 283: mod_base = OTHER; note = uracil
  modified_base 286: mod_base = OTHER; note = uracil
  modified_base 287: mod_base = OTHER; note = uracil
  modified_base 288: mod_base = OTHER; note = uracil
  modified_base 293: mod_base = OTHER; note = uracil
  modified_base 294: mod_base = OTHER; note = uracil
  modified_base 300: mod_base = OTHER; note = uracil
gaagaygatattttttagttgggyggggaggagggttatygttttttggttatttaattagagatatttttagtttgatggyggaggtygttagggttaagggtttttagggtttttttyggggaattttygagatttgtttyggattyggaggtttatygygtatygttygtttttagttttattagtatygatattygtygtttttttttyggttttygatggttttagaatttaaaggttaaattttaatttygttttagtagtttttttyggttttgtttatttagygttagttgt

SEQ ID NO: 545 - DNA, 300 bp, synthetic construct
  misc_feature 1..300: note = Synthetic polynucleotide
  source 1..300: mol_type = other DNA
  modified_base 4: mod_base = OTHER; note = uracil
  modified_base 6: mod_base = OTHER; note = uracil
  modified_base 7: mod_base = OTHER; note = uracil
  modified_base 8: mod_base = OTHER; note = uracil
  modified_base 10: mod_base = OTHER; note = uracil
  modified_base 16: mod_base = OTHER; note = uracil
  modified_base 19: mod_base = OTHER; note = uracil
  modified_base 20: mod_base = OTHER; note = uracil
  modified_base 24: mod_base = OTHER; note = uracil
  modified_base 25: mod_base = OTHER; note = uracil
  modified_base 36: mod_base = OTHER; note = uracil
  modified_base 38: mod_base = OTHER; note = uracil
  modified_base 41: mod_base = OTHER; note = uracil
  modified_base 46: mod_base = OTHER; note = uracil
  modified_base 47: mod_base = OTHER; note = uracil
  modified_base 49: mod_base = OTHER; note = uracil
  modified_base 53: mod_base = OTHER; note = uracil
  modified_base 54: mod_base = OTHER; note = uracil
  modified_base 56: mod_base = OTHER; note = uracil
  modified_base 57: mod_base = OTHER; note = uracil
  modified_base 64: mod_base = OTHER; note = uracil
  modified_base 65: mod_base = OTHER; note = uracil
  modified_base 66: mod_base = OTHER; note = uracil
  modified_base 68: mod_base = OTHER; note = uracil
  modified_base 69: mod_base = OTHER; note = uracil
  modified_base 76: mod_base = OTHER; note = uracil
  modified_base 78: mod_base = OTHER; note = uracil
  modified_base 83: mod_base = OTHER; note = uracil
  modified_base 84: mod_base = OTHER; note = uracil
  modified_base 85: mod_base = OTHER; note = uracil
  modified_base 99: mod_base = OTHER; note = uracil
  modified_base 104: mod_base = OTHER; note = uracil
  modified_base 108: mod_base = OTHER; note = uracil
  modified_base 109: mod_base = OTHER; note = uracil
  modified_base 110: mod_base = OTHER; note = uracil
  modified_base 112: mod_base = OTHER; note = uracil
  modified_base 124: mod_base = OTHER; note = uracil
  modified_base 125: mod_base = OTHER; note = uracil
  modified_base 130: mod_base = OTHER; note = uracil
  modified_base 134: mod_base = OTHER; note = uracil
  modified_base 139: mod_base = OTHER; note = uracil
  modified_base 140: mod_base = OTHER; note = uracil
  modified_base 141: mod_base = OTHER; note = uracil
  modified_base 142: mod_base = OTHER; note = uracil
  modified_base 146: mod_base = OTHER; note = uracil
  modified_base 147: mod_base = OTHER; note = uracil
  modified_base 153: mod_base = OTHER; note = uracil
  modified_base 171: mod_base = OTHER; note = uracil
  modified_base 174: mod_base = OTHER; note = uracil
  modified_base 177: mod_base = OTHER; note = uracil
  modified_base 178: mod_base = OTHER; note = uracil
  modified_base 182: mod_base = OTHER; note = uracil
  modified_base 183: mod_base = OTHER; note = uracil
  modified_base 187: mod_base = OTHER; note = uracil
  modified_base 189: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 199: mod_base = OTHER; note = uracil
  modified_base 202: mod_base = OTHER; note = uracil
  modified_base 203: mod_base = OTHER; note = uracil
  modified_base 208: mod_base = OTHER; note = uracil
  modified_base 209: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 218: mod_base = OTHER; note = uracil
  modified_base 219: mod_base = OTHER; note = uracil
  modified_base 220: mod_base = OTHER; note = uracil
  modified_base 231: mod_base = OTHER; note = uracil
  modified_base 236: mod_base = OTHER; note = uracil
  modified_base 242: mod_base = OTHER; note = uracil
  modified_base 249: mod_base = OTHER; note = uracil
  modified_base 272: mod_base = OTHER; note = uracil
  modified_base 274: mod_base = OTHER; note = uracil
  modified_base 278: mod_base = OTHER; note = uracil
  modified_base 285: mod_base = OTHER; note = uracil
  modified_base 287: mod_base = OTHER; note = uracil
  modified_base 288: mod_base = OTHER; note = uracil
  modified_base 296: mod_base = OTHER; note = uracil
  modified_base 297: mod_base = OTHER; note = uracil
gggtattttttggtgtttttaggtttgtgaattggtatagtaggattatagatttttaaggtgtttatttgggggtttagaattttggyggggaaggttagtgttattttatyggagaagagatttagtttagttgagtttttggttagyggtaaggaggaaaggatgaatattagttaygtttggtattgattgttatagttagagtttygtttagtttaagaatgtttttgttttaagattttttttttttttgtattttagaaattattataggtaaatgttattttgaagattygg

SEQ ID NO: 546 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 7: mod_base = OTHER; note = uracil
  modified_base 10: mod_base = OTHER; note = uracil
  modified_base 18: mod_base = OTHER; note = uracil
  modified_base 24: mod_base = OTHER; note = uracil
  modified_base 25: mod_base = OTHER; note = uracil
  modified_base 37: mod_base = OTHER; note = uracil
  modified_base 45: mod_base = OTHER; note = uracil
  modified_base 61: mod_base = OTHER; note = uracil
  modified_base 68: mod_base = OTHER; note = uracil
  modified_base 74: mod_base = OTHER; note = uracil
  modified_base 78: mod_base = OTHER; note = uracil
  modified_base 84: mod_base = OTHER; note = uracil
  modified_base 94: mod_base = OTHER; note = uracil
  modified_base 96: mod_base = OTHER; note = uracil
  modified_base 100: mod_base = OTHER; note = uracil
  modified_base 106: mod_base = OTHER; note = uracil
  modified_base 110: mod_base = OTHER; note = uracil
  modified_base 115: mod_base = OTHER; note = uracil
  modified_base 116: mod_base = OTHER; note = uracil
  modified_base 125: mod_base = OTHER; note = uracil
  modified_base 133: mod_base = OTHER; note = uracil
  modified_base 136: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 144: mod_base = OTHER; note = uracil
  modified_base 145: mod_base = OTHER; note = uracil
  modified_base 149: mod_base = OTHER; note = uracil
  modified_base 152: mod_base = OTHER; note = uracil
  modified_base 156: mod_base = OTHER; note = uracil
  modified_base 157: mod_base = OTHER; note = uracil
  modified_base 163: mod_base = OTHER; note = uracil
  modified_base 165: mod_base = OTHER; note = uracil
  modified_base 168: mod_base = OTHER; note = uracil
  modified_base 173: mod_base = OTHER; note = uracil
  modified_base 179: mod_base = OTHER; note = uracil
  modified_base 181: mod_base = OTHER; note = uracil
  modified_base 184: mod_base = OTHER; note = uracil
  modified_base 186: mod_base = OTHER; note = uracil
  modified_base 198: mod_base = OTHER; note = uracil
  modified_base 200: mod_base = OTHER; note = uracil
  modified_base 204: mod_base = OTHER; note = uracil
  modified_base 205: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 213: mod_base = OTHER; note = uracil
  modified_base 214: mod_base = OTHER; note = uracil
  modified_base 221: mod_base = OTHER; note = uracil
  modified_base 226: mod_base = OTHER; note = uracil
  modified_base 227: mod_base = OTHER; note = uracil
  modified_base 228: mod_base = OTHER; note = uracil
  modified_base 229: mod_base = OTHER; note = uracil
  modified_base 230: mod_base = OTHER; note = uracil
  modified_base 238: mod_base = OTHER; note = uracil
  modified_base 240: mod_base = OTHER; note = uracil
  modified_base 241: mod_base = OTHER; note = uracil
  modified_base 250: mod_base = OTHER; note = uracil
  modified_base 257: mod_base = OTHER; note = uracil
  modified_base 258: mod_base = OTHER; note = uracil
  modified_base 261: mod_base = OTHER; note = uracil
  modified_base 266: mod_base = OTHER; note = uracil
  modified_base 267: mod_base = OTHER; note = uracil
  modified_base 272: mod_base = OTHER; note = uracil
  modified_base 274: mod_base = OTHER; note = uracil
  modified_base 278: mod_base = OTHER; note = uracil
  modified_base 279: mod_base = OTHER; note = uracil
  modified_base 286: mod_base = OTHER; note = uracil
  modified_base 288: mod_base = OTHER; note = uracil
  modified_base 289: mod_base = OTHER; note = uracil
  modified_base 298: mod_base = OTHER; note = uracil
  modified_base 299: mod_base = OTHER; note = uracil
  modified_base 300: mod_base = OTHER; note = uracil
tygggtttttaaggtgatatttgtttgtgataatttttaaaatataaaaaagaaaaaagttttagaatagaaatatttttgggttgggygaggttttggttgtggtagttagtgttaggygtggttgatgtttatttttttttttttgtygttggttaggggtttagttagattaggtttttttttyggtgggatagtattgatttttttygttagggttttgagtttttaggtgggtattttggaggtttgtggttttgttgtgttaatttataggtttggaagtattagagggtgttt

SEQ ID NO: 547 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 15: mod_base = OTHER; note = uracil
  modified_base 23: mod_base = OTHER; note = uracil
  modified_base 32: mod_base = OTHER; note = uracil
  modified_base 35: mod_base = OTHER; note = uracil
  modified_base 38: mod_base = OTHER; note = uracil
  modified_base 41: mod_base = OTHER; note = uracil
  modified_base 46: mod_base = OTHER; note = uracil
  modified_base 54: mod_base = OTHER; note = uracil
  modified_base 63: mod_base = OTHER; note = uracil
  modified_base 66: mod_base = OTHER; note = uracil
  modified_base 67: mod_base = OTHER; note = uracil
  modified_base 68: mod_base = OTHER; note = uracil
  modified_base 71: mod_base = OTHER; note = uracil
  modified_base 72: mod_base = OTHER; note = uracil
  modified_base 74: mod_base = OTHER; note = uracil
  modified_base 79: mod_base = OTHER; note = uracil
  modified_base 82: mod_base = OTHER; note = uracil
  modified_base 83: mod_base = OTHER; note = uracil
  modified_base 84: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 90: mod_base = OTHER; note = uracil
  modified_base 92: mod_base = OTHER; note = uracil
  modified_base 93: mod_base = OTHER; note = uracil
  modified_base 96: mod_base = OTHER; note = uracil
  modified_base 97: mod_base = OTHER; note = uracil
  modified_base 101: mod_base = OTHER; note = uracil
  modified_base 102: mod_base = OTHER; note = uracil
  modified_base 111: mod_base = OTHER; note = uracil
  modified_base 112: mod_base = OTHER; note = uracil
  modified_base 118: mod_base = OTHER; note = uracil
  modified_base 119: mod_base = OTHER; note = uracil
  modified_base 120: mod_base = OTHER; note = uracil
  modified_base 122: mod_base = OTHER; note = uracil
  modified_base 123: mod_base = OTHER; note = uracil
  modified_base 129: mod_base = OTHER; note = uracil
  modified_base 136: mod_base = OTHER; note = uracil
  modified_base 140: mod_base = OTHER; note = uracil
  modified_base 145: mod_base = OTHER; note = uracil
  modified_base 149: mod_base = OTHER; note = uracil
  modified_base 163: mod_base = OTHER; note = uracil
  modified_base 168: mod_base = OTHER; note = uracil
  modified_base 169: mod_base = OTHER; note = uracil
  modified_base 170: mod_base = OTHER; note = uracil
  modified_base 176: mod_base = OTHER; note = uracil
  modified_base 188: mod_base = OTHER; note = uracil
  modified_base 189: mod_base = OTHER; note = uracil
  modified_base 190: mod_base = OTHER; note = uracil
  modified_base 201: mod_base = OTHER; note = uracil
  modified_base 202: mod_base = OTHER; note = uracil
  modified_base 203: mod_base = OTHER; note = uracil
  modified_base 210: mod_base = OTHER; note = uracil
  modified_base 212: mod_base = OTHER; note = uracil
  modified_base 213: mod_base = OTHER; note = uracil
  modified_base 220: mod_base = OTHER; note = uracil
  modified_base 237: mod_base = OTHER; note = uracil
  modified_base 239: mod_base = OTHER; note = uracil
  modified_base 242: mod_base = OTHER; note = uracil
  modified_base 247: mod_base = OTHER; note = uracil
  modified_base 248: mod_base = OTHER; note = uracil
  modified_base 249: mod_base = OTHER; note = uracil
  modified_base 252: mod_base = OTHER; note = uracil
  modified_base 253: mod_base = OTHER; note = uracil
  modified_base 256: mod_base = OTHER; note = uracil
  modified_base 263: mod_base = OTHER; note = uracil
  modified_base 265: mod_base = OTHER; note = uracil
  modified_base 266: mod_base = OTHER; note = uracil
  modified_base 276: mod_base = OTHER; note = uracil
  modified_base 278: mod_base = OTHER; note = uracil
  modified_base 291: mod_base = OTHER; note = uracil
  modified_base 298: mod_base = OTHER; note = uracil
tttatggagaggagtagagatgtaggaaaygtaatagtagtayggtagaaaygtaggagaaatagtttygttttagagtygtttattttttttygttatgttaggaagggttagtgtttttttagaygtyggtgattgttaygttagataygtgaygtgtggttgtgtttagatttttggyggtgagtttyggygagggatttagyggtttttyggygtttggtttagggggggattttygtaagatttygttygtaygtggtttttgtgaggggtattgygygygaaggttgtggtttg

SEQ ID NO: 548 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 11: mod_base = OTHER; note = uracil
  modified_base 12: mod_base = OTHER; note = uracil
  modified_base 21: mod_base = OTHER; note = uracil
  modified_base 26: mod_base = OTHER; note = uracil
  modified_base 27: mod_base = OTHER; note = uracil
  modified_base 28: mod_base = OTHER; note = uracil
  modified_base 29: mod_base = OTHER; note = uracil
  modified_base 31: mod_base = OTHER; note = uracil
  modified_base 33: mod_base = OTHER; note = uracil
  modified_base 39: mod_base = OTHER; note = uracil
  modified_base 40: mod_base = OTHER; note = uracil
  modified_base 56: mod_base = OTHER; note = uracil
  modified_base 67: mod_base = OTHER; note = uracil
  modified_base 68: mod_base = OTHER; note = uracil
  modified_base 69: mod_base = OTHER; note = uracil
  modified_base 70: mod_base = OTHER; note = uracil
  modified_base 71: mod_base = OTHER; note = uracil
  modified_base 72: mod_base = OTHER; note = uracil
  modified_base 73: mod_base = OTHER; note = uracil
  modified_base 78: mod_base = OTHER; note = uracil
  modified_base 79: mod_base = OTHER; note = uracil
  modified_base 85: mod_base = OTHER; note = uracil
  modified_base 93: mod_base = OTHER; note = uracil
  modified_base 96: mod_base = OTHER; note = uracil
  modified_base 102: mod_base = OTHER; note = uracil
  modified_base 103: mod_base = OTHER; note = uracil
  modified_base 104: mod_base = OTHER; note = uracil
  modified_base 108: mod_base = OTHER; note = uracil
  modified_base 114: mod_base = OTHER; note = uracil
  modified_base 116: mod_base = OTHER; note = uracil
  modified_base 118: mod_base = OTHER; note = uracil
  modified_base 121: mod_base = OTHER; note = uracil
  modified_base 122: mod_base = OTHER; note = uracil
  modified_base 129: mod_base = OTHER; note = uracil
  modified_base 134: mod_base = OTHER; note = uracil
  modified_base 136: mod_base = OTHER; note = uracil
  modified_base 139: mod_base = OTHER; note = uracil
  modified_base 140: mod_base = OTHER; note = uracil
  modified_base 142: mod_base = OTHER; note = uracil
  modified_base 147: mod_base = OTHER; note = uracil
  modified_base 154: mod_base = OTHER; note = uracil
  modified_base 163: mod_base = OTHER; note = uracil
  modified_base 167: mod_base = OTHER; note = uracil
  modified_base 169: mod_base = OTHER; note = uracil
  modified_base 176: mod_base = OTHER; note = uracil
  modified_base 185: mod_base = OTHER; note = uracil
  modified_base 187: mod_base = OTHER; note = uracil
  modified_base 191: mod_base = OTHER; note = uracil
  modified_base 192: mod_base = OTHER; note = uracil
  modified_base 193: mod_base = OTHER; note = uracil
  modified_base 196: mod_base = OTHER; note = uracil
  modified_base 197: mod_base = OTHER; note = uracil
  modified_base 201: mod_base = OTHER; note = uracil
  modified_base 223: mod_base = OTHER; note = uracil
  modified_base 225: mod_base = OTHER; note = uracil
  modified_base 236: mod_base = OTHER; note = uracil
  modified_base 242: mod_base = OTHER; note = uracil
  modified_base 244: mod_base = OTHER; note = uracil
  modified_base 245: mod_base = OTHER; note = uracil
  modified_base 253: mod_base = OTHER; note = uracil
  modified_base 256: mod_base = OTHER; note = uracil
  modified_base 261: mod_base = OTHER; note = uracil
  modified_base 264: mod_base = OTHER; note = uracil
  modified_base 275: mod_base = OTHER; note = uracil
  modified_base 276: mod_base = OTHER; note = uracil
  modified_base 279: mod_base = OTHER; note = uracil
  modified_base 282: mod_base = OTHER; note = uracil
  modified_base 284: mod_base = OTHER; note = uracil
  modified_base 287: mod_base = OTHER; note = uracil
  modified_base 289: mod_base = OTHER; note = uracil
  modified_base 290: mod_base = OTHER; note = uracil
  modified_base 292: mod_base = OTHER; note = uracil
  modified_base 294: mod_base = OTHER; note = uracil
  modified_base 295: mod_base = OTHER; note = uracil
tagattatagttttygygygtagtgttttttataggagttaygtgygggyggggttttgyggagatttttttttaaattagaygtygggagatygttgggtttttygtyggggtttatygttaagaatttgggtatagttataygttaygtgtttgaygtgatagttatyggygtttggagggatattggttttttttggtatggygggaggaggtgggyggttttgaggyggggttgttttttttgygtttttgtygtgttgttgttgygttttttgtatttttgtttttttttatgag

SEQ ID NO: 549 - DNA, 300 bp, synthetic construct
  misc_feature 1..300: note = Synthetic polynucleotide
  source 1..300: mol_type = other DNA
  modified_base 1: mod_base = OTHER; note = uracil
  modified_base 3: mod_base = OTHER; note = uracil
  modified_base 5: mod_base = OTHER; note = uracil
  modified_base 6: mod_base = OTHER; note = uracil
  modified_base 8: mod_base = OTHER; note = uracil
  modified_base 13: mod_base = OTHER; note = uracil
  modified_base 17: mod_base = OTHER; note = uracil
  modified_base 18: mod_base = OTHER; note = uracil
  modified_base 20: mod_base = OTHER; note = uracil
  modified_base 21: mod_base = OTHER; note = uracil
  modified_base 30: mod_base = OTHER; note = uracil
  modified_base 35: mod_base = OTHER; note = uracil
  modified_base 36: mod_base = OTHER; note = uracil
  modified_base 62: mod_base = OTHER; note = uracil
  modified_base 65: mod_base = OTHER; note = uracil
  modified_base 68: mod_base = OTHER; note = uracil
  modified_base 82: mod_base = OTHER; note = uracil
  modified_base 84: mod_base = OTHER; note = uracil
  modified_base 85: mod_base = OTHER; note = uracil
  modified_base 86: mod_base = OTHER; note = uracil
  modified_base 87: mod_base = OTHER; note = uracil
  modified_base 89: mod_base = OTHER; note = uracil
  modified_base 91: mod_base = OTHER; note = uracil
  modified_base 92: mod_base = OTHER; note = uracil
  modified_base 93: mod_base = OTHER; note = uracil
  modified_base 94: mod_base = OTHER; note = uracil
  modified_base 95: mod_base = OTHER; note = uracil
  modified_base 101: mod_base = OTHER; note = uracil
  modified_base 103: mod_base = OTHER; note = uracil
  modified_base 104: mod_base = OTHER; note = uracil
  modified_base 106: mod_base = OTHER; note = uracil
  modified_base 114: mod_base = OTHER; note = uracil
  modified_base 120: mod_base = OTHER; note = uracil
  modified_base 121: mod_base = OTHER; note = uracil
  modified_base 124: mod_base = OTHER; note = uracil
  modified_base 125: mod_base = OTHER; note = uracil
  modified_base 126: mod_base = OTHER; note = uracil
  modified_base 131: mod_base = OTHER; note = uracil
  modified_base 132: mod_base = OTHER; note = uracil
  modified_base 137: mod_base = OTHER; note = uracil
  modified_base 138: mod_base = OTHER; note = uracil
  modified_base 146: mod_base = OTHER; note = uracil
  modified_base 150: mod_base = OTHER; note = uracil
  modified_base 151: mod_base = OTHER; note = uracil
  modified_base 161: mod_base = OTHER; note = uracil
  modified_base 162: mod_base = OTHER; note = uracil
  modified_base 165: mod_base = OTHER; note = uracil
  modified_base 166: mod_base = OTHER; note = uracil
  modified_base 169: mod_base = OTHER; note = uracil
  modified_base 175: mod_base = OTHER; note = uracil
  modified_base 181: mod_base = OTHER; note = uracil
  modified_base 183: mod_base = OTHER; note = uracil
  modified_base 190: mod_base = OTHER; note = uracil
  modified_base 194: mod_base = OTHER; note = uracil
  modified_base 203: mod_base = OTHER; note = uracil
  modified_base 204: mod_base = OTHER; note = uracil
  modified_base 208: mod_base = OTHER; note = uracil
  modified_base 209: mod_base = OTHER; note = uracil
  modified_base 210: mod_base = OTHER; note = uracil
  modified_base 211: mod_base = OTHER; note = uracil
  modified_base 213: mod_base = OTHER; note = uracil
  modified_base 214: mod_base = OTHER; note = uracil
  modified_base 215: mod_base = OTHER; note = uracil
  modified_base 223: mod_base = OTHER; note = uracil
  modified_base 224: mod_base = OTHER; note = uracil
  modified_base 226: mod_base = OTHER; note = uracil
  modified_base 232: mod_base = OTHER; note = uracil
  modified_base 240: mod_base = OTHER; note = uracil
  modified_base 241: mod_base = OTHER; note = uracil
  modified_base 242: mod_base = OTHER; note = uracil
  modified_base 247: mod_base = OTHER; note = uracil
  modified_base 250: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 264: mod_base = OTHER; note = uracil
  modified_base 265: mod_base = OTHER; note = uracil
  modified_base 269: mod_base = OTHER; note = uracil
  modified_base 273: mod_base = OTHER; note = uracil
  modified_base 275: mod_base = OTHER; note = uracil
  modified_base 276: mod_base = OTHER; note = uracil
  modified_base 277: mod_base = OTHER; note = uracil
  modified_base 279: mod_base = OTHER; note = uracil
  modified_base 284: mod_base = OTHER; note = uracil
  modified_base 285: mod_base = OTHER; note = uracil
  modified_base 286: mod_base = OTHER; note = uracil
  modified_base 294: mod_base = OTHER; note = uracil
  modified_base 295: mod_base = OTHER; note = uracil
  modified_base 296: mod_base = OTHER; note = uracil
  modified_base 299: mod_base = OTHER; note = uracil
  modified_base 300: mod_base = OTHER; note = uracil
ttttttattgtgtaggttatttgtagggatagtgttagtgggtgtaggagaggtggygaggttgtagtagtgygggatgggttttttatatttttaaatattttatatggggttyggggtttttttaggatttgggttaggtgygtaygtttgggyggggttagttagttygtgttgagttatygggtgtygttagtgagggtttggttttattttygggaattatyggtgttggtttttttayggttgttgttygttgtgggttttgttgttatttataaggttttgggaggttttgtt

SEQ ID NO: 550 - DNA, 300 bp, synthetic construct
  misc_feature 1..300: note = Synthetic polynucleotide
  source 1..300: mol_type = other DNA
  modified_base 3: mod_base = OTHER; note = uracil
  modified_base 8: mod_base = OTHER; note = uracil
  modified_base 9: mod_base = OTHER; note = uracil
  modified_base 11: mod_base = OTHER; note = uracil
  modified_base 12: mod_base = OTHER; note = uracil
  modified_base 13: mod_base = OTHER; note = uracil
  modified_base 18: mod_base = OTHER; note = uracil
  modified_base 19: mod_base = OTHER; note = uracil
  modified_base 30: mod_base = OTHER; note = uracil
  modified_base 33: mod_base = OTHER; note = uracil
  modified_base 38: mod_base = OTHER; note = uracil
  modified_base 39: mod_base = OTHER; note = uracil
  modified_base 40: mod_base = OTHER; note = uracil
  modified_base 42: mod_base = OTHER; note = uracil
  modified_base 49: mod_base = OTHER; note = uracil
  modified_base 52: mod_base = OTHER; note = uracil
  modified_base 55: mod_base = OTHER; note = uracil
  modified_base 66: mod_base = OTHER; note = uracil
  modified_base 67: mod_base = OTHER; note = uracil
  modified_base 70: mod_base = OTHER; note = uracil
  modified_base 72: mod_base = OTHER; note = uracil
  modified_base 81: mod_base = OTHER; note = uracil
  modified_base 82: mod_base = OTHER; note = uracil
  modified_base 94: mod_base = OTHER; note = uracil
  modified_base 95: mod_base = OTHER; note = uracil
  modified_base 99: mod_base = OTHER; note = uracil
  modified_base 100: mod_base = OTHER; note = uracil
  modified_base 101: mod_base = OTHER; note = uracil
  modified_base 103: mod_base = OTHER; note = uracil
  modified_base 105: mod_base = OTHER; note = uracil
  modified_base 112: mod_base = OTHER; note = uracil
  modified_base 114: mod_base = OTHER; note = uracil
  modified_base 115: mod_base = OTHER; note = uracil
  modified_base 122: mod_base = OTHER; note = uracil
  modified_base 124: mod_base = OTHER; note = uracil
  modified_base 127: mod_base = OTHER; note = uracil
  modified_base 133: mod_base = OTHER; note = uracil
  modified_base 137: mod_base = OTHER; note = uracil
  modified_base 141: mod_base = OTHER; note = uracil
  modified_base 142: mod_base = OTHER; note = uracil
  modified_base 143: mod_base = OTHER; note = uracil
  modified_base 146: mod_base = OTHER; note = uracil
  modified_base 147: mod_base = OTHER; note = uracil
  modified_base 148: mod_base = OTHER; note = uracil
  modified_base 158: mod_base = OTHER; note = uracil
  modified_base 160: mod_base = OTHER; note = uracil
  modified_base 161: mod_base = OTHER; note = uracil
  modified_base 165: mod_base = OTHER; note = uracil
  modified_base 166: mod_base = OTHER; note = uracil
  modified_base 167: mod_base = OTHER; note = uracil
  modified_base 172: mod_base = OTHER; note = uracil
  modified_base 173: mod_base = OTHER; note = uracil
  modified_base 182: mod_base = OTHER; note = uracil
  modified_base 183: mod_base = OTHER; note = uracil
  modified_base 184: mod_base = OTHER; note = uracil
  modified_base 189: mod_base = OTHER; note = uracil
  modified_base 190: mod_base = OTHER; note = uracil
  modified_base 191: mod_base = OTHER; note = uracil
  modified_base 192: mod_base = OTHER; note = uracil
  modified_base 220: mod_base = OTHER; note = uracil
  modified_base 221: mod_base = OTHER; note = uracil
  modified_base 222: mod_base = OTHER; note = uracil
  modified_base 225: mod_base = OTHER; note = uracil
  modified_base 226: mod_base = OTHER; note = uracil
  modified_base 229: mod_base = OTHER; note = uracil
  modified_base 231: mod_base = OTHER; note = uracil
  modified_base 234: mod_base = OTHER; note = uracil
  modified_base 237: mod_base = OTHER; note = uracil
  modified_base 240: mod_base = OTHER; note = uracil
  modified_base 241: mod_base = OTHER; note = uracil
  modified_base 245: mod_base = OTHER; note = uracil
  modified_base 246: mod_base = OTHER; note = uracil
  modified_base 248: mod_base = OTHER; note = uracil
  modified_base 249: mod_base = OTHER; note = uracil
  modified_base 251: mod_base = OTHER; note = uracil
  modified_base 253: mod_base = OTHER; note = uracil
  modified_base 254: mod_base = OTHER; note = uracil
  modified_base 257: mod_base = OTHER; note = uracil
  modified_base 259: mod_base = OTHER; note = uracil
  modified_base 260: mod_base = OTHER; note = uracil
  modified_base 261: mod_base = OTHER; note = uracil
  modified_base 263: mod_base = OTHER; note = uracil
  modified_base 267: mod_base = OTHER; note = uracil
  modified_base 269: mod_base = OTHER; note = uracil
  modified_base 273: mod_base = OTHER; note = uracil
  modified_base 274: mod_base = OTHER; note = uracil
  modified_base 275: mod_base = OTHER; note = uracil
  modified_base 278: mod_base = OTHER; note = uracil
  modified_base 285: mod_base = OTHER; note = uracil
  modified_base 286: mod_base = OTHER; note = uracil
  modified_base 289: mod_base = OTHER; note = uracil
  modified_base 291: mod_base = OTHER; note = uracil
ggtagggttttttagggttttgtgggtgatagtaaggtttatagygggtagtagtygtgggaaaattagtatyggtggttttygagggtggggttaggtttttattgayggtattyggtgatttagtaygagttggttggtttygtttaggygtgygtatttggtttaggttttgggaaggtttyggattttatgtggagtatttgggggtgtggggagtttatttygtattgttgtagtttygttattttttttatatttattggtattgtttttataggtggtttgtatagtggagag

SEQ ID NO: 551 - DNA, 19 bp, synthetic construct
  misc_feature 1..19: note = Synthetic polynucleotide
  source 1..19: mol_type = other DNA
gggagaagagattggaaaa

SEQ ID NO: 552 - DNA, 27 bp, synthetic construct
  misc_feature 1..27: note = Synthetic polynucleotide
  source 1..27: mol_type = other DNA
ctaaaaacctaacactaacaacataat

SEQ ID NO: 553 - DNA, 20 bp, synthetic construct
  misc_feature 1..20: note = Synthetic polynucleotide
  source 1..20: mol_type = other DNA
tgttgtttaaaatgttgttt

SEQ ID NO: 554 - DNA, 20 bp, synthetic construct
  misc_feature 1..20: note = Synthetic polynucleotide
  source 1..20: mol_type = other DNA
aaccctaaataattcttctc

SEQ ID NO: 555 - DNA, 18 bp, synthetic construct
  misc_feature 1..18: note = Synthetic polynucleotide
  source 1..18: mol_type = other DNA
gggttgggttgaggtttt

SEQ ID NO: 556 - DNA, 25 bp, synthetic construct
  misc_feature 1..25: note = Synthetic polynucleotide
  source 1..25: mol_type = other DNA
acaccttacatctcatttacaactc

SEQ ID NO: 557 - DNA, 21 bp, synthetic construct
  misc_feature 1..21: note = Synthetic polynucleotide
  source 1..21: mol_type = other DNA
aatttgtgaaaagtttgtgta

SEQ ID NO: 558 - DNA, 18 bp, synthetic construct
  misc_feature 1..18: note = Synthetic polynucleotide
  source 1..18: mol_type = other DNA
cccaatcacctttaatct

SEQ ID NO: 559 - DNA, 20 bp, synthetic construct
  misc_feature 1..20: note = Synthetic polynucleotide
  source 1..20: mol_type = other DNA
gttgggatttgaaatagtga

SEQ ID NO: 560 - DNA, 20 bp, synthetic construct
  misc_feature 1..20: note = Synthetic polynucleotide
  source 1..20: mol_type = other DNA
cctccactcacctaaaactt

SEQ ID NO: 561 - DNA, 20 bp, synthetic construct
  misc_feature 1..20: note = Synthetic polynucleotide
  source 1..20: mol_type = other DNA
ttggttagtgattatttatt

SEQ ID NO: 562 - DNA, 22 bp, synthetic construct
  misc_feature 1..22: note = Synthetic polynucleotide
  source 1..22: mol_type = other DNA
aaaaattaatataaaattaaaa

SEQ ID NO: 563 - DNA, 19 bp, synthetic construct
  misc_feature 1..19: note = Synthetic polynucleotide
  source 1..19: mol_type = other DNA
tttgtagggagttagggat

SEQ ID NO: 564 - DNA, 20 bp, synthetic construct
  misc_feature 1..20: note = Synthetic polynucleotide
  source 1..20: mol_type = other DNA
tcctctatctcaccctaaat

SEQ ID NO: 565 - DNA, 23 bp, synthetic construct
  misc_feature 1..23: note = Synthetic polynucleotide
  source 1..23: mol_type = other DNA
tttgattgaattatttgtgtatt

SEQ ID NO: 566 - DNA, 21 bp, synthetic construct
  misc_feature 1..21: note = Synthetic polynucleotide
  source 1..21: mol_type = other DNA
actcccttactcctaaacact

SEQ ID NO: 567 - DNA, 19 bp, synthetic construct
  misc_feature 1..19: note = Synthetic polynucleotide
  source 1..19: mol_type = other DNA
agtggagatggtagggaga

SEQ ID NO: 568 - DNA, 23 bp, synthetic construct
  misc_feature 1..23: note = Synthetic polynucleotide
  source 1..23: mol_type = other DNA
cccaaaactaaaaccaaatataa

SEQ ID NO: 569 - DNA, 18 bp, synthetic construct
  misc_feature 1..18: note = Synthetic polynucleotide
  source 1..18: mol_type = other DNA
ttgtggttaaatttattg

SEQ ID NO: 570 - DNA, 18 bp, synthetic construct
  misc_feature 1..18: note = Synthetic polynucleotide
  source 1..18: mol_type = other DNA
acccaacaaaataatatc

SEQ ID NO: 571 - DNA, 22 bp, synthetic construct
  misc_feature 1..22: note = Synthetic polynucleotide
  source 1..22: mol_type = other DNA
tgaggtagagttgtgtgtatat

SEQ ID NO: 572 - DNA, 21 bp, synthetic construct
  misc_feature 1..21: note = Synthetic polynucleotide
  source 1..21: mol_type = other DNA
atcaatcaattctcattaaac

SEQ ID NO: 573 - DNA, 19 bp, synthetic construct
  misc_feature 1..19: note = Synthetic polynucleotide
  source 1..19: mol_type = other DNA
ggaagttaggaagggttgt

SEQ ID NO: 574 - DNA, 21 bp, synthetic construct
  misc_feature 1..21: note = Synthetic polynucleotide
  source 1..21: mol_type = other DNA
ctccaactccaactaaaactc

SEQ ID NO: 575 - DNA, 19 bp, synthetic construct
  misc_feature 1..19: note = Synthetic polynucleotide
  source 1..19: mol_type = other DNA
ttgggtattgatttatttt

SEQ ID NO: 576 - DNA, 23 bp, synthetic construct
  misc_feature 1..23: note = Synthetic polynucleotide
  source 1..23: mol_type = other DNA
aaattctacctacaaactataca

SEQ ID NO: 577 - DNA, 25 bp, synthetic construct
  misc_feature 1..25: note = Synthetic polynucleotide
  source 1..25: mol_type = other DNA
aggatgaagtaataattaaatattg

SEQ ID NO: 578 - DNA, 19 bp, synthetic construct
  misc_feature 1..19: note = Synthetic polynucleotide
  source 1..19: mol_type = other DNA
cccactctaccaactaaac

SEQ ID NO: 579 - DNA, 20 bp, synthetic construct
  misc_feature 1..20: note = Synthetic polynucleotide
  source 1..20: mol_type = other DNA
aggtttgtgttagtataaat

SEQ ID NO: 580 - DNA, 24 bp, synthetic construct
  misc_feature 1..24: note = Synthetic polynucleotide
  source 1..24: mol_type = other DNA
ttcttacctatataattaataata

SEQ ID NO: 581 - DNA, 19 bp, synthetic construct
  misc_feature 1..19: note = Synthetic polynucleotide
  source 1..19: mol_type = other DNA
gttgggtgaattttattag

SEQ ID NO: 582 - DNA, 20 bp, synthetic construct
  misc_feature 1..20: note = Synthetic polynucleotide
  source 1..20: mol_type = other DNA
tcaaaacctaaactctaaca

SEQ ID NO: 583 - DNA, 24 bp, synthetic construct
  misc_feature 1..24: note = Synthetic polynucleotide
  source 1..24: mol_type = other DNA
ggattggttttatatagaaagtat

SEQ ID NO: 584 - DNA, 26 bp, synthetic construct
  misc_feature 1..26: note = Synthetic polynucleotide
  source 1..26: mol_type = other DNA
caaataataaatcataactcttaact

SEQ ID NO: 585 - DNA, 18 bp, synthetic construct
  misc_feature 1..18: note = Synthetic polynucleotide
  source 1..18: mol_type = other DNA
tggggtagttgatggttt

SEQ ID NO: 586 - DNA, 26 bp, synthetic construct
  misc_feature 1..26: note = Synthetic polynucleotide
  source 1..26: mol_type = other DNA
ctttctaacaaaataaaaaaatttaa

SEQ ID NO: 587 - DNA, 28 bp, synthetic construct
  misc_feature 1..28: note = Synthetic polynucleotide
  source 1..28: mol_type = other DNA
ttgtatttgaagtttgtagagatttata

SEQ ID NO: 588 - DNA, 19 bp, synthetic construct
  misc_feature 1..19: note = Synthetic polynucleotide
  source 1..19: mol_type = other DNA
tttcctccaacaactcaat

SEQ ID NO: 589 - DNA, 27 bp, synthetic construct
  misc_feature 1..27: note = Synthetic polynucleotide
  source 1..27: mol_type = other DNA
ttatgagtatgtagtagggttattata

SEQ ID NO: 590 - DNA, 22 bp, synthetic construct
  misc_feature 1..22: note = Synthetic polynucleotide
  source 1..22: mol_type = other DNA
aaaatatcaaacaaatttatcc

SEQ ID NO: 591 - DNA, 23 bp, synthetic construct
  misc_feature 1..23: note = Synthetic polynucleotide
  source 1..23: mol_type = other DNA
tggttgtttgttttttatgtatt

SEQ ID NO: 592 - DNA, 18 bp, synthetic construct
  misc_feature 1..18: note = Synthetic polynucleotide
  source 1..18: mol_type = other DNA
tccctacctcccaaattc

SEQ ID NO: 593 - DNA, 23 bp, synthetic construct
  misc_feature 1..23: note = Synthetic polynucleotide
  source 1..23: mol_type = other DNA
tatgatgattgttgtagtgtaga

SEQ ID NO: 594 - DNA, 22 bp, synthetic construct
  misc_feature 1..22: note = Synthetic polynucleotide
  source 1..22: mol_type = other DNA
cctccctaataactaaaaatac

SEQ ID NO: 595 - DNA, 20 bp, synthetic construct
  misc_feature 1..20: note = Synthetic polynucleotide
  source 1..20: mol_type = other DNA
ggtggttttgatatttagtg

SEQ ID NO: 596 - DNA, 20 bp, synthetic construct
  misc_feature 1..20: note = Synthetic polynucleotide
  source 1..20: mol_type = other DNA
cccaattacctaacaaatta

SEQ ID NO: 597 - DNA, 19 bp, synthetic construct
  misc_feature 1..19: note = Synthetic polynucleotide
  source 1..19: mol_type = other DNA
tgggataggtgtagatatg

SEQ ID NO: 598 - DNA, 23 bp, synthetic construct
  misc_feature 1..23: note = Synthetic polynucleotide
  source 1..23: mol_type = other DNA
caacaaaaactaaaacactatac

SEQ ID NO: 599 - DNA, 18 bp, synthetic construct
  misc_feature 1..18: note = Synthetic polynucleotide
  source 1..18: mol_type = other DNA
tttgggattggttatttt

SEQ ID NO: 600 - DNA, 20 bp, synthetic construct
  misc_feature 1..20: note = Synthetic polynucleotide
  source 1..20: mol_type = other DNA
aaaccccttaactctatacc

SEQ ID NO: 601 - DNA, 22 bp, synthetic construct
  misc_feature 1..22: note = Synthetic polynucleotide
  source 1..22: mol_type = other DNA
gatttttttgagaagagtatag

SEQ ID NO: 602 - DNA, 21 bp, synthetic construct
  misc_feature 1..21: note = Synthetic polynucleotide
  source 1..21: mol_type = other DNA
aaccactaccacctaaatata

SEQ ID NO: 603 - DNA, 18 bp, synthetic construct
  misc_feature 1..18: note = Synthetic polynucleotide
  source 1..18: mol_type = other DNA
ggaggatagggtgtgatt

SEQ ID NO: 604 - DNA, 27 bp, synthetic construct
  misc_feature 1..27: note = Synthetic polynucleotide
  source 1..27: mol_type = other DNA
acatttttaactctaactaaaaataaa

SEQ ID NO: 605 - DNA, 18 bp, synthetic construct
  misc_feature 1..18: note = Synthetic polynucleotide
  source 1..18: mol_type = other DNA
tggaaatgaggtgagttt

SEQ ID NO: 606 - DNA, 26 bp, synthetic construct
  misc_feature 1..26: note = Synthetic polynucleotide
  source 1..26: mol_type = other DNA
aaaaaaaaataaaataacaataacta

SEQ ID NO: 607 - DNA, 19 bp, synthetic construct
  misc_feature 1..19: note = Synthetic polynucleotide
  source 1..19: mol_type = other DNA
tggagagtttagtttgttt

SEQ ID NO: 608 - DNA, 19 bp, synthetic construct
  misc_feature 1..19: note = Synthetic polynucleotide
  source 1..19: mol_type = other DNA
caaaaaaaaatctaacaac

SEQ ID NO: 609 - DNA, 20 bp, synthetic construct
  misc_feature 1..20: note = Synthetic polynucleotide
  source 1..20: mol_type = other DNA
tgggttttagttatgtggtt

SEQ ID NO: 610 - DNA, 26 bp, synthetic construct
  misc_feature 1..26: note = Synthetic polynucleotide
  source 1..26: mol_type = other DNA
atcaataatatccaacaaaataatat

SEQ ID NO: 611 - DNA, 27 bp, synthetic construct
  misc_feature 1..27: note = Synthetic polynucleotide
  source 1..27: mol_type = other DNA
tttttttagtttttgtatatatattag

SEQ ID NO: 612 - DNA, 19 bp, synthetic construct
  misc_feature 1..19: note = Synthetic polynucleotide
  source 1..19: mol_type = other DNA
acccaaataatcaactctt

SEQ ID NO: 613 - DNA, 18 bp, synthetic construct
  misc_feature 1..18: note = Synthetic polynucleotide
  source 1..18: mol_type = other DNA
gtggtttttggagattta

SEQ ID NO: 614 - DNA, 25 bp, synthetic construct
  misc_feature 1..25: note = Synthetic polynucleotide
  source 1..25: mol_type = other DNA
aaacaaactacaaataaaataatac

SEQ ID NO: 615 - DNA, 19 bp, synthetic construct
  misc_feature 1..19: note = Synthetic polynucleotide
  source 1..19: mol_type = other DNA
gggttataggtttgagtta

SEQ ID NO: 616 - DNA, 20 bp, synthetic construct
  misc_feature 1..20: note = Synthetic polynucleotide
  source 1..20: mol_type = other DNA
ccattaaaaaaaataaaatc

SEQ ID NO: 617 - DNA, 23 bp, synthetic construct
  misc_feature 1..23: note = Synthetic polynucleotide
  source 1..23: mol_type = other DNA
ttggtagatttagtaaatttatt

SEQ ID NO: 618 - DNA, 22 bp, synthetic construct
  misc_feature 1..22: note = Synthetic polynucleotide
  source 1..22: mol_type = other DNA
aaacttaaacaaccctatatac

SEQ ID NO: 619 - DNA, 27 bp, synthetic construct
  misc_feature 1..27: note = Synthetic polynucleotide
  source 1..27: mol_type = other DNA
atggttttaaagagtagtagtatagtt

SEQ ID NO: 620 - DNA, 20 bp, synthetic construct
  misc_feature 1..20: note = Synthetic polynucleotide
  source 1..20: mol_type = other DNA
aaatttactcatcccacttc

SEQ ID NO: 621 - DNA, 18 bp, synthetic construct
  misc_feature 1..18: note = Synthetic polynucleotide
  source 1..18: mol_type = other DNA
aggggttgggatattgtt

SEQ ID NO: 622 - DNA, 25 bp, synthetic construct
  misc_feature 1..25: note = Synthetic polynucleotide
  source 1..25: mol_type = other DNA
aaaaatttctcctacaaaaaactaa

SEQ ID NO: 623 - DNA, 20 bp, synthetic construct
  misc_feature 1..20: note = Synthetic polynucleotide
  source 1..20: mol_type = other DNA
atgggtgtttggaattttta

SEQ ID NO: 624 - DNA, 25 bp, synthetic construct
  misc_feature 1..25: note = Synthetic polynucleotide
  source 1..25: mol_type = other DNA
ctacctcaacctcctaaataactaa

SEQ ID NO: 625 - DNA, 22 bp, synthetic construct
  misc_feature 1..22: note = Synthetic polynucleotide
  source 1..22: mol_type = other DNA
gtgttttgtggtaaagatatag

SEQ ID NO: 626 - DNA, 24 bp, synthetic construct
  misc_feature 1..24: note = Synthetic polynucleotide
  source 1..24: mol_type = other DNA
attcttaaattaattcaactacat

SEQ ID NO: 627 - DNA, 20 bp, synthetic construct
  misc_feature 1..20: note = Synthetic polynucleotide
  source 1..20: mol_type = other DNA
tgggggtaaaagttatagtt

SEQ ID NO: 628 - DNA, 21 bp, synthetic construct
  misc_feature 1..21: note = Synthetic polynucleotide
  source 1..21: mol_type = other DNA
aaaaaacaaaaaaccaaatac

SEQ ID NO: 629 - DNA, 19 bp, synthetic construct
  misc_feature 1..19: note = Synthetic polynucleotide
  source 1..19: mol_type = other DNA
gttttttggttagtgtgtt

SEQ ID NO: 630 - DNA, 22 bp, synthetic construct
  misc_feature 1..22: note = Synthetic polynucleotide
  source 1..22: mol_type = other DNA
ccccatacttctatactataat

SEQ ID NO: 631 - DNA, 23 bp, synthetic construct
  misc_feature 1..23: note = Synthetic polynucleotide
  source 1..23: mol_type = other DNA
ttgttgtttttaaagaaattata

SEQ ID NO: 632 - DNA, 24 bp, synthetic construct
  misc_feature 1..24: note = Synthetic polynucleotide
  source 1..24: mol_type = other DNA
atcatctaaacttaactcatctaa

SEQ ID NO: 633 - DNA, 20 bp, synthetic construct
  misc_feature 1..20: note = Synthetic polynucleotide
  source 1..20: mol_type = other DNA
atttttgggtgttttatatt

SEQ ID NO: 634 - DNA, 18 bp, synthetic construct
  misc_feature 1..18: note = Synthetic polynucleotide
  source 1..18: mol_type = other DNA
aaacctcaaacaataaca

SEQ ID NO: 635 - DNA, 24 bp, synthetic construct
  misc_feature 1..24: note = Synthetic polynucleotide
  source 1..24: mol_type = other DNA
attaaggatatttaggagagtaag

SEQ ID NO: 636 - DNA, 20 bp, synthetic construct
  misc_feature 1..20: note = Synthetic polynucleotide
  source 1..20: mol_type = other DNA
acaccacaacttcaaactac

SEQ ID NO: 637 - DNA, 23 bp, synthetic construct
  misc_feature 1..23: note = Synthetic polynucleotide
  source 1..23: mol_type = other DNA
tgaggaagagagaagagatgata

SEQ ID NO: 638 - DNA, 30 bp, synthetic construct
  misc_feature 1..30: note = Synthetic polynucleotide
  source 1..30: mol_type = other DNA
aaaactaaactataaaacaaaacaaaacta

SEQ ID NO: 639 - DNA, 20 bp, synthetic construct
  misc_feature 1..20: note = Synthetic polynucleotide
  source 1..20: mol_type = other DNA
ggtggaggtgttttttatag

SEQ ID NO: 640 - DNA, 23 bp, synthetic construct
  misc_feature 1..23: note = Synthetic polynucleotide
  source 1..23: mol_type = other DNA
ccaaatactactttcaaaataca

SEQ ID NO: 641 - DNA, 21 bp, synthetic construct
  misc_feature 1..21: note = Synthetic polynucleotide
  source 1..21: mol_type = other DNA
atggattattattgtgttatt

SEQ ID NO: 642 - DNA, 19 bp, synthetic construct
  misc_feature 1..19: note = Synthetic polynucleotide
  source 1..19: mol_type = other DNA
catctcaacctcatactaa

SEQ ID NO: 643 - DNA, 22 bp, synthetic construct
  misc_feature 1..22: note = Synthetic polynucleotide
  source 1..22: mol_type = other DNA
ggatgatttagtagggattgag

SEQ ID NO: 644 - DNA, 23 bp, synthetic construct
  misc_feature 1..23: note = Synthetic polynucleotide
  source 1..23: mol_type = other DNA
ccaaataaaaaccattctctaac

SEQ ID NO: 645 - DNA, 24 bp, synthetic construct
  misc_feature 1..24: note = Synthetic polynucleotide
  source 1..24: mol_type = other DNA
ttggattaagtatttttgatatta

SEQ ID NO: 646 - DNA, 23 bp, synthetic construct
  misc_feature 1..23: note = Synthetic polynucleotide
  source 1..23: mol_type = other DNA
tccctaaaccatatattactaaa

SEQ ID NO: 647 - DNA, 22 bp, synthetic construct
  misc_feature 1..22: note = Synthetic polynucleotide
  source 1..22: mol_type = other DNA
gggtagtttggtgattattatt

SEQ ID NO: 648 - DNA, 19 bp, synthetic construct
  misc_feature 1..19: note = Synthetic polynucleotide
  source 1..19: mol_type = other DNA
cccttccctactcacaata

SEQ ID NO: 649 - DNA, 23 bp, synthetic construct
  misc_feature 1..23: note = Synthetic polynucleotide
  source 1..23: mol_type = other DNA
atttggttagtgatttagttatt

SEQ ID NO: 650 - DNA, 21 bp, synthetic construct
  misc_feature 1..21: note = Synthetic polynucleotide
  source 1..21: mol_type = other DNA
tcccacttaaaaaattctata

SEQ ID NO: 651 - DNA, 21 bp, synthetic construct
  misc_feature 1..21: note = Synthetic polynucleotide
  source 1..21: mol_type = other DNA
agtggggaaggtaattgttat

SEQ ID NO: 652 - DNA, 30 bp, synthetic construct
  misc_feature 1..30: note = Synthetic polynucleotide
  source 1..30: mol_type = other DNA
ctttctaataaaaatttactaaaacctcta

SEQ ID NO: 653 - DNA, 24 bp, synthetic construct
  misc_feature 1..24: note = Synthetic polynucleotide
  source 1..24: mol_type = other DNA
tttggttagttttatttttgattg

SEQ ID NO: 654 - DNA, 20 bp, synthetic construct
  misc_feature 1..20: note = Synthetic polynucleotide
  source 1..20: mol_type = other DNA
attcctccctatccctattc

SEQ ID NO: 655 - DNA, 19 bp, synthetic construct
  misc_feature 1..19: note = Synthetic polynucleotide
  source 1..19: mol_type = other DNA
gggataggggttagagtaa

SEQ ID NO: 656 - DNA, 20 bp, synthetic construct
  misc_feature 1..20: note = Synthetic polynucleotide
  source 1..20: mol_type = other DNA
tccataaaaacaaaacactc

SEQ ID NO: 657 - DNA, 25 bp, synthetic construct
  misc_feature 1..25: note = Synthetic polynucleotide
  source 1..25: mol_type = other DNA
ttttttagtatgagttataaattat

SEQ ID NO: 658 - DNA, 23 bp, synthetic construct
  misc_feature 1..23: note = Synthetic polynucleotide
  source 1..23: mol_type = other DNA
aaaacaaaatctacctatatatt

SEQ ID NO: 659 - DNA, 23 bp, synthetic construct
  misc_feature 1..23: note = Synthetic polynucleotide
  source 1..23: mol_type = other DNA
ttttattaataaagtaggtatga

SEQ ID NO: 660 - DNA, 20 bp, synthetic construct
  misc_feature 1..20: note = Synthetic polynucleotide
  source 1..20: mol_type = other DNA
acctttctcaaaattactaa

SEQ ID NO: 661 - DNA, 22 bp, synthetic construct
  misc_feature 1..22: note = Synthetic polynucleotide
  source 1..22: mol_type = other DNA
atagggttgaggttagagttat

SEQ ID NO: 662 - DNA, 18 bp, synthetic construct
  misc_feature 1..18: note = Synthetic polynucleotide
  source 1..18: mol_type = other DNA
cctcctctccacaataaa

SEQ ID NO: 663 - DNA, 26 bp, synthetic construct
  misc_feature 1..26: note = Synthetic polynucleotide
  source 1..26: mol_type = other DNA
tttaagtttttttttagttttgtagt

SEQ ID NO: 664 - DNA, 18 bp, synthetic construct
  misc_feature 1..18: note = Synthetic polynucleotide
  source 1..18: mol_type = other DNA
ccccatcctctctatctc

SEQ ID NO: 665 - DNA, 26 bp, synthetic construct
  misc_feature 1..26: note = Synthetic polynucleotide
  source 1..26: mol_type = other DNA
aaatttaaaatttagaggtttttata

SEQ ID NO: 666 - DNA, 24 bp, synthetic construct
  misc_feature 1..24: note = Synthetic polynucleotide
  source 1..24: mol_type = other DNA
aaacttcacacacaaatctatatt

SEQ ID NO: 667 - DNA, 25 bp, synthetic construct
  misc_feature 1..25: note = Synthetic polynucleotide
  source 1..25: mol_type = other DNA
tttttattttattttttatttttaa

SEQ ID NO: 668 - DNA, 24 bp, synthetic construct
  misc_feature 1..24: note = Synthetic polynucleotide
  source 1..24: mol_type = other DNA
atacctccctaattatattattaa

SEQ ID NO: 669 - DNA, 25 bp, synthetic construct
  misc_feature 1..25: note = Synthetic polynucleotide
  source 1..25: mol_type = other DNA
ttttagaatatttaaagaagttagt

SEQ ID NO: 670 - DNA, 19 bp, synthetic construct
  misc_feature 1..19: note = Synthetic polynucleotide
  source 1..19: mol_type = other DNA
taacctcactttcctatca

SEQ ID NO: 671 - DNA, 26 bp, synthetic construct
  misc_feature 1..26: note = Synthetic polynucleotide
  source 1..26: mol_type = other DNA
aatttagtataagatttgatttgtta

SEQ ID NO: 672 - DNA, 20 bp, synthetic construct
  misc_feature 1..20: note = Synthetic polynucleotide
  source 1..20: mol_type = other DNA
ccacctactccttcctatac

SEQ ID NO: 673 - DNA, 21 bp, synthetic construct
  misc_feature 1..21: note = Synthetic polynucleotide
  source 1..21: mol_type = other DNA
ttttttgaaattgtatgttat

SEQ ID NO: 674 - DNA, 21 bp, synthetic construct
  misc_feature 1..21: note = Synthetic polynucleotide
  source 1..21: mol_type = other DNA
caaatccttaaaattctataa

SEQ ID NO: 675 - DNA, 18 bp, synthetic construct
  misc_feature 1..18: note = Synthetic polynucleotide
  source 1..18: mol_type = other DNA
tttgaagtggtgttttag

SEQ ID NO: 676 - DNA, 18 bp, synthetic construct
  misc_feature 1..18: note = Synthetic polynucleotide
  source 1..18: mol_type = other DNA
ccaaaattcttccatact

SEQ ID NO: 677 - DNA, 20 bp, synthetic construct
  misc_feature 1..20: note = Synthetic polynucleotide
  source 1..20: mol_type = other DNA
tgggtatttagttttttgtg

SEQ ID NO: 678 - DNA, 23 bp, synthetic construct
  misc_feature 1..23: note = Synthetic polynucleotide
  source 1..23: mol_type = other DNA
aacaactacctccttttactaat

SEQ ID NO: 679 - DNA, 19 bp, synthetic construct
  misc_feature 1..19: note = Synthetic polynucleotide
  source 1..19: mol_type = other DNA
tatggtaggaggtggagtt

SEQ ID NO: 680 - DNA, 19 bp, synthetic construct
  misc_feature 1..19: note = Synthetic polynucleotide
  source 1..19: mol_type = other DNA
cccaattttaaaacaatac

SEQ ID NO: 681 - DNA, 22 bp, synthetic construct
  misc_feature 1..22: note = Synthetic polynucleotide
  source 1..22: mol_type = other DNA
agaggaagtaaggttattagtt

SEQ ID NO: 682 - DNA, 20 bp, synthetic construct
  misc_feature 1..20: note = Synthetic polynucleotide
  source 1..20: mol_type = other DNA
accaaacaaacaatatctaa

SEQ ID NO: 683 - DNA, 24 bp, synthetic construct
  misc_feature 1..24: note = Synthetic polynucleotide
  source 1..24: mol_type = other DNA
ggttttaattatgatttaattaga

SEQ ID NO: 684 - DNA, 22 bp, synthetic construct
  misc_feature 1..22: note = Synthetic polynucleotide
  source 1..22: mol_type = other DNA
cctacactcaaatttacctcta

SEQ ID NO: 685 - DNA, 23 bp, synthetic construct
  misc_feature 1..23: note = Synthetic polynucleotide
  source 1..23: mol_type = other DNA
aatgggtagttgatataattatt

SEQ ID NO: 686 - DNA, 21 bp, synthetic construct
  misc_feature 1..21: note = Synthetic polynucleotide
  source 1..21: mol_type = other DNA
cacaaaatcctaaaactaaaa

SEQ ID NO: 687 - DNA, 22 bp, synthetic construct
  misc_feature 1..22: note = Synthetic polynucleotide
  source 1..22: mol_type = other DNA
aggattagtggaaatgaaaata

SEQ ID NO: 688 - DNA, 23 bp, synthetic construct
  misc_feature 1..23: note = Synthetic polynucleotide
  source 1..23: mol_type = other DNA
taacctcaaaacaacttctaaac

SEQ ID NO: 689 - DNA, 25 bp, synthetic construct
  misc_feature 1..25: note = Synthetic polynucleotide
  source 1..25: mol_type = other DNA
ttttttttatagagaagtattttag

SEQ ID NO: 690 - DNA, 18 bp, synthetic construct
  misc_feature 1..18: note = Synthetic polynucleotide
  source 1..18: mol_type = other DNA
cccattacaaaactatcc

SEQ ID NO: 691 - DNA, 19 bp, synthetic construct
  misc_feature 1..19: note = Synthetic polynucleotide
  source 1..19: mol_type = other DNA
ggtgagtttgtggttagtg

SEQ ID NO: 692 - DNA, 22 bp, synthetic construct
  misc_feature 1..22: note = Synthetic polynucleotide
  source 1..22: mol_type = other DNA
ttttctaaaaaaatccaatcta

SEQ ID NO: 693 - DNA, 19 bp, synthetic construct
  misc_feature 1..19: note = Synthetic polynucleotide
  source 1..19: mol_type = other DNA
aatggataggttggaatag

SEQ ID NO: 694 - DNA, 23 bp, synthetic construct
  misc_feature 1..23: note = Synthetic polynucleotide
  source 1..23: mol_type = other DNA
aaaaaaaaaaaaaaactaattac

SEQ ID NO: 695 - DNA, 22 bp, synthetic construct
  misc_feature 1..22: note = Synthetic polynucleotide
  source 1..22: mol_type = other DNA
gagttatttagtttggttaggt

SEQ ID NO: 696 - DNA, 24 bp, synthetic construct
  misc_feature 1..24: note = Synthetic polynucleotide
  source 1..24: mol_type = other DNA
actcaacttaaaaaatcactatac

SEQ ID NO: 697 - DNA, 22 bp, synthetic construct
  misc_feature 1..22: note = Synthetic polynucleotide
  source 1..22: mol_type = other DNA
ttttttttggttttttggtttt

SEQ ID NO: 698 - DNA, 18 bp, synthetic construct
  misc_feature 1..18: note = Synthetic polynucleotide
  source 1..18: mol_type = other DNA
tcccccacacccatataa

SEQ ID NO: 699 - DNA, 25 bp, synthetic construct
  misc_feature 1..25: note = Synthetic polynucleotide
  source 1..25: mol_type = other DNA
ttaaaaaaaagtataatgagtagga

SEQ ID NO: 700 - DNA, 19 bp, synthetic construct
  misc_feature 1..19: note = Synthetic polynucleotide
  source 1..19: mol_type = other DNA
cccacaaaaactctctaca

SEQ ID NO: 701 - DNA, 24 bp, synthetic construct
  misc_feature 1..24: note = Synthetic polynucleotide
  source 1..24: mol_type = other DNA
aaaggaggttgagttagaaagtag

SEQ ID NO: 702 - DNA, 26 bp, synthetic construct
  misc_feature 1..26: note = Synthetic polynucleotide
  source 1..26: mol_type = other DNA
aactatttaacttacttaaccacacc

SEQ ID NO: 703 - DNA, 25 bp, synthetic construct
  misc_feature 1..25: note = Synthetic polynucleotide
  source 1..25: mol_type = other DNA
ggtgtggttaagtaagttaaatagt

SEQ ID NO: 704 - DNA, 18 bp, synthetic construct
  misc_feature 1..18: note = Synthetic polynucleotide
  source 1..18: mol_type = other DNA
taccccttcctcttcaac

SEQ ID NO: 705 - DNA, 24 bp, synthetic construct
  misc_feature 1..24: note = Synthetic polynucleotide
  source 1..24: mol_type = other DNA
ttttgatatgatttatgattatat

SEQ ID NO: 706 - DNA, 20 bp, synthetic construct
  misc_feature 1..20: note = Synthetic polynucleotide
  source 1..20: mol_type = other DNA
ttttccactaaacaacacta

SEQ ID NO: 707 - DNA, 19 bp, synthetic construct
  misc_feature 1..19: note = Synthetic polynucleotide
  source 1..19: mol_type = other DNA
tttgagggttgttttagat

SEQ ID NO: 708 - DNA, 26 bp, synthetic construct
  misc_feature 1..26: note = Synthetic polynucleotide
  source 1..26: mol_type = other DNA
actcacaaaaaataactaataactat

SEQ ID NO: 709 - DNA, 21 bp, synthetic construct
  misc_feature 1..21: note = Synthetic polynucleotide
  source 1..21: mol_type = other DNA
aaaggaggtaggggagatata

SEQ ID NO: 710 - DNA, 23 bp, synthetic construct
  misc_feature 1..23: note = Synthetic polynucleotide
  source 1..23: mol_type = other DNA
tcaaaataaaaaccaaaattctc

SEQ ID NO: 711 - DNA, 22 bp, synthetic construct
  misc_feature 1..22: note = Synthetic polynucleotide
  source 1..22: mol_type = other DNA
aggttaagttggtagaggtaga

SEQ ID NO: 712 - DNA, 25 bp, synthetic construct
  misc_feature 1..25: note = Synthetic polynucleotide
  source 1..25: mol_type = other DNA
caaactctaaactcaaaatatattc

SEQ ID NO: 713 - DNA, 24 bp, synthetic construct
  misc_feature 1..24: note = Synthetic polynucleotide
  source 1..24: mol_type = other DNA
tttttattttagttttttgagtag

SEQ ID NO: 714 - DNA, 20 bp, synthetic construct
  misc_feature 1..20: note = Synthetic polynucleotide
  source 1..20: mol_type = other DNA
ccctacaacactcctatcta

SEQ ID NO: 715 - DNA, 19 bp, synthetic construct
  misc_feature 1..19: note = Synthetic polynucleotide
  source 1..19: mol_type = other DNA
tttggagttaggttgatag

SEQ ID NO: 716 - DNA, 21 bp, synthetic construct
  misc_feature 1..21: note = Synthetic polynucleotide
  source 1..21: mol_type = other DNA
caacaatactctcacttacac

SEQ ID NO: 717 - DNA, 25 bp, synthetic construct
  misc_feature 1..25: note = Synthetic polynucleotide
  source 1..25: mol_type = other DNA
agaaagatttttaaatatttttaat

SEQ ID NO: 718 - DNA, 21 bp, synthetic construct
  misc_feature 1..21: note = Synthetic polynucleotide
  source 1..21: mol_type = other DNA
aaacctctaatacacaacaaa

SEQ ID NO: 719 - DNA, 23 bp, synthetic construct
  misc_feature 1..23: note = Synthetic polynucleotide
  source 1..23: mol_type = other DNA
ttttgagttttttttttaagtat

SEQ ID NO: 720 - DNA, 22 bp, synthetic construct
  misc_feature 1..22: note = Synthetic polynucleotide
  source 1..22: mol_type = other DNA
caaacaaaacaacacttaatac

SEQ ID NO: 721 - DNA, 19 bp, synthetic construct
  misc_feature 1..19: note = Synthetic polynucleotide
  source 1..19: mol_type = other DNA
ggttgaggtgggtggatta

SEQ ID NO: 722 - DNA, 30 bp, synthetic construct
  misc_feature 1..30: note = Synthetic polynucleotide
  source 1..30: mol_type = other DNA
ttttttttttttttttttaaaataaaatct

SEQ ID NO: 723 - DNA, 20 bp, synthetic construct
  misc_feature 1..20: note = Synthetic polynucleotide
  source 1..20: mol_type = other DNA
gggtgtttgtaattttagtt

SEQ ID NO: 724 - DNA, 23 bp, synthetic construct
  misc_feature 1..23: note = Synthetic polynucleotide
  source 1..23: mol_type = other DNA
acctttaacaacctaacaatata

SEQ ID NO: 725 - DNA, 21 bp, synthetic construct
  misc_feature 1..21: note = Synthetic polynucleotide
  source 1..21: mol_type = other DNA
gggtagatgatatggtagtga

SEQ ID NO: 726 - DNA, 28 bp, synthetic construct
  misc_feature 1..28: note = Synthetic polynucleotide
  source 1..28: mol_type = other DNA
aaaaaataaaaaataactaaaacaatat

SEQ ID NO: 727 - DNA, 22 bp, synthetic construct
  misc_feature 1..22: note = Synthetic polynucleotide
  source 1..22: mol_type = other DNA
aggaagtgtttaagaagtagaa

SEQ ID NO: 728 - DNA, 23 bp, synthetic construct
  misc_feature 1..23: note = Synthetic polynucleotide
  source 1..23: mol_type = other DNA
cctaaaactctaaatacaatctc

SEQ ID NO: 729 - DNA, 21 bp, synthetic construct
  misc_feature 1..21: note = Synthetic polynucleotide
  source 1..21: mol_type = other DNA
tttttaatttttgtttgtatt

SEQ ID NO: 730 - DNA, 20 bp, synthetic construct
  misc_feature 1..20: note = Synthetic polynucleotide
  source 1..20: mol_type = other DNA
aaaccacaatctatttctaa

SEQ ID NO: 731 - DNA, 23 bp, synthetic construct
  misc_feature 1..23: note = Synthetic polynucleotide
  source 1..23: mol_type = other DNA
ttagaaaagaataattatagttg

SEQ ID NO: 732 - DNA, 19 bp, synthetic construct
  misc_feature 1..19: note = Synthetic polynucleotide
  source 1..19: mol_type = other DNA
accctaaaaaaataaaatc

SEQ ID NO: 733 - DNA, 26 bp, synthetic construct
  misc_feature 1..26: note = Synthetic polynucleotide
  source 1..26: mol_type = other DNA
ttgtattagtaaataaagtgtatttt

SEQ ID NO: 734 - DNA, 20 bp, synthetic construct
  misc_feature 1..20: note = Synthetic polynucleotide
  source 1..20: mol_type = other DNA
aaccctttctacaaatctac

SEQ ID NO: 735 - DNA, 18 bp, synthetic construct
  misc_feature 1..18: note = Synthetic polynucleotide
  source 1..18: mol_type = other DNA
aggggtgggtggaagaat

SEQ ID NO: 736 - DNA, 31 bp, synthetic construct
  misc_feature 1..31: note = Synthetic polynucleotide
  source 1..31: mol_type = other DNA
ctcctcaataaaataaaaatcctaaaaaata

SEQ ID NO: 737 - DNA, 20 bp, synthetic construct
  misc_feature 1..20: note = Synthetic polynucleotide
  source 1..20: mol_type = other DNA
gggttaattagttgttttat

SEQ ID NO: 738 - DNA, 21 bp, synthetic construct
  misc_feature 1..21: note = Synthetic polynucleotide
  source 1..21: mol_type = other DNA
cctacaaatatatcacacact

SEQ ID NO: 739 - DNA, 21 bp, synthetic construct
  misc_feature 1..21: note = Synthetic polynucleotide
  source 1..21: mol_type = other DNA
tttgttaaataggtggttaga

SEQ ID NO: 740 - DNA, 20 bp, synthetic construct
  misc_feature 1..20: note = Synthetic polynucleotide
  source 1..20: mol_type = other DNA
acctcaacctcctaaataac

SEQ ID NO: 741 - DNA, 22 bp, synthetic construct
  misc_feature 1..22: note = Synthetic polynucleotide
  source 1..22: mol_type = other DNA
tagggtttagagtaggaggtag

SEQ ID NO: 742 - DNA, 24 bp, synthetic construct
  misc_feature 1..24: note = Synthetic polynucleotide
  source 1..24: mol_type = other DNA
caaaaaatataaatcaaaaacatc

SEQ ID NO: 743 - DNA, 21 bp, synthetic construct
  misc_feature 1..21: note = Synthetic polynucleotide
  source 1..21: mol_type = other DNA
gggattataggtatttattat

SEQ ID NO: 744 - DNA, 22 bp, synthetic construct
  misc_feature 1..22: note = Synthetic polynucleotide
  source 1..22: mol_type = other DNA
taaaaattaaaaatcatactta

SEQ ID NO: 745 - DNA, 20 bp, synthetic construct
  misc_feature 1..20: note = Synthetic polynucleotide
  source 1..20: mol_type = other DNA
aagtgatttttagggagtgt

SEQ ID NO: 746 - DNA, 23 bp, synthetic construct
  misc_feature 1..23: note = Synthetic polynucleotide
  source 1..23: mol_type = other DNA
tccataataacctcattttaata

SEQ ID NO: 747 - DNA, 19 bp, synthetic construct
  misc_feature 1..19: note = Synthetic polynucleotide
  source 1..19: mol_type = other DNA
tttttggttgaggtttagt

SEQ ID NO: 748 - DNA, 21 bp, synthetic construct
  misc_feature 1..21: note = Synthetic polynucleotide
  source 1..21: mol_type = other DNA
aaacaacacaactcttatcac

SEQ ID NO: 749 - DNA, 24 bp, synthetic construct
  misc_feature 1..24: note = Synthetic polynucleotide
  source 1..24: mol_type = other DNA
tatggtgattaaagtataatagtt

SEQ ID NO: 750 - DNA, 21 bp, synthetic construct
  misc_feature 1..21: note = Synthetic polynucleotide
  source 1..21: mol_type = other DNA
tcctaaataaaaaacaacata

SEQ ID NO: 751 - DNA, 23 bp, synthetic construct
  misc_feature 1..23: note = Synthetic polynucleotide
  source 1..23: mol_type = other DNA
tgaaaatgtttttagtttttatt

SEQ ID NO: 752 - DNA, 22 bp, synthetic construct
  misc_feature 1..22: note = Synthetic polynucleotide
  source 1..22: mol_type = other DNA
aaataccctacctcttatctaa

SEQ ID NO: 753 - DNA, 20 bp, synthetic construct
  misc_feature 1..20: note = Synthetic polynucleotide
  source 1..20: mol_type = other DNA
gatggttaatttttttattt

SEQ ID NO: 754 - DNA, 19 bp, synthetic construct
  misc_feature 1..19: note = Synthetic polynucleotide
  source 1..19: mol_type = other DNA
actccttcaacaaactaac

SEQ ID NO: 755 - DNA, 18 bp, synthetic construct
  misc_feature 1..18: note = Synthetic polynucleotide
  source 1..18: mol_type = other DNA
aggggatatttttaggtt

SEQ ID NO: 756 - DNA, 23 bp, synthetic construct
  misc_feature 1..23: note = Synthetic polynucleotide
  source 1..23: mol_type = other DNA
ccaatctattcctatataattaa

SEQ ID NO: 757 - DNA, 20 bp, synthetic construct
  misc_feature 1..20: note = Synthetic polynucleotide
  source 1..20: mol_type = other DNA
aggagagtttggaaatatag

SEQ ID NO: 758 - DNA, 22 bp, synthetic construct
  misc_feature 1..22: note = Synthetic polynucleotide
  source 1..22: mol_type = other DNA
caattctaaattaaaccttatt

SEQ ID NO: 759 - DNA, 23 bp, synthetic construct
  misc_feature 1..23: note = Synthetic polynucleotide
  source 1..23: mol_type = other DNA
aataatggtagtagttttattag

SEQ ID NO: 760 - DNA, 21 bp, synthetic construct
  misc_feature 1..21: note = Synthetic polynucleotide
  source 1..21: mol_type = other DNA
ttcctatattaacaacttaca

SEQ ID NO: 761 - DNA, 19 bp, synthetic construct
  misc_feature 1..19: note = Synthetic polynucleotide
  source 1..19: mol_type = other DNA
ttttttggtagatttttat

SEQ ID NO: 762 - DNA, 25 bp, synthetic construct
  misc_feature 1..25: note = Synthetic polynucleotide
  source 1..25: mol_type = other DNA
aaattaatttctattatttatatta

SEQ ID NO: 763 - DNA, 18 bp, synthetic construct
  misc_feature 1..18: note = Synthetic polynucleotide
  source 1..18: mol_type = other DNA
aggtggttggggagagtg

SEQ ID NO: 764 - DNA, 28 bp, synthetic construct
  misc_feature 1..28: note = Synthetic polynucleotide
  source 1..28: mol_type = other DNA
ccctaaaataaatcaaaaaaaaccttaa

SEQ ID NO: 765 - DNA, 19 bp, synthetic construct
  misc_feature 1..19: note = Synthetic polynucleotide
  source 1..19: mol_type = other DNA
aggtttaggtggggtgaat

SEQ ID NO: 766 - DNA, 24 bp, synthetic construct
  misc_feature 1..24: note = Synthetic polynucleotide
  source 1..24: mol_type = other DNA
taaaatcatcaaaatcccttaaaa

SEQ ID NO: 767 - DNA, 25 bp, synthetic construct
  misc_feature 1..25: note = Synthetic polynucleotide
  source 1..25: mol_type = other DNA
tttttttttaggttataggagtatt

SEQ ID NO: 768 - DNA, 18 bp, synthetic construct
  misc_feature 1..18: note = Synthetic polynucleotide
  source 1..18: mol_type = other DNA
atccccacaaaacacata

SEQ ID NO: 769 - DNA, 22 bp, synthetic construct
  misc_feature 1..22: note = Synthetic polynucleotide
  source 1..22: mol_type = other DNA
tagggtaaatattgggattatt

SEQ ID NO: 770 - DNA, 20 bp, synthetic construct
  misc_feature 1..20: note = Synthetic polynucleotide
  source 1..20: mol_type = other DNA
tttccacctcaaaacttaac

SEQ ID NO: 771 - DNA, 21 bp, synthetic construct
  misc_feature 1..21: note = Synthetic polynucleotide
  source 1..21: mol_type = other DNA
gggtgtttgtatttttatatt

SEQ ID NO: 772 - DNA, 18 bp, synthetic construct
  misc_feature 1..18: note = Synthetic polynucleotide
  source 1..18: mol_type = other DNA
acctcccaaaaccataac

SEQ ID NO: 773 - DNA, 20 bp, synthetic construct
  misc_feature 1..20: note = Synthetic polynucleotide
  source 1..20: mol_type = other DNA
gatgtgagtggtgaggtggt

SEQ ID NO: 774 - DNA, 22 bp, synthetic construct
  misc_feature 1..22: note = Synthetic polynucleotide
  source 1..22: mol_type = other DNA
caaacccttccaaaacataaac

SEQ ID NO: 775 - DNA, 20 bp, synthetic construct
  misc_feature 1..20: note = Synthetic polynucleotide
  source 1..20: mol_type = other DNA
tgggattataggtatgtatt

SEQ ID NO: 776 - DNA, 25 bp, synthetic construct
  misc_feature 1..25: note = Synthetic polynucleotide
  source 1..25: mol_type = other DNA
caatttcatttataaatataaatat

SEQ ID NO: 777 - DNA, 22 bp, synthetic construct
  misc_feature 1..22: note = Synthetic polynucleotide
  source 1..22: mol_type = other DNA
aggggttggttatttttatttt

SEQ ID NO: 778 - DNA, 29 bp, synthetic construct
  misc_feature 1..29: note = Synthetic polynucleotide
  source 1..29: mol_type = other DNA
tttttaatatttaatttttaccttcaact

SEQ ID NO: 779 - DNA, 20 bp, synthetic construct
  misc_feature 1..20: note = Synthetic polynucleotide
  source 1..20: mol_type = other DNA
ggtaagttgtggatgtgagt

SEQ ID NO: 780 - DNA, 22 bp, synthetic construct
  misc_feature 1..22: note = Synthetic polynucleotide
  source 1..22: mol_type = other DNA
aaaaaaaaccaaaccttatcta

SEQ ID NO: 781 - DNA, 19 bp, synthetic construct
  misc_feature 1..19: note = Synthetic polynucleotide
  source 1..19: mol_type = other DNA
tttttaggatttgggttag

SEQ ID NO: 782 - DNA, 23 bp, synthetic construct
  misc_feature 1..23: note = Synthetic polynucleotide
  source 1..23: mol_type = other DNA
aaccttataaataacaacaaaac

What is claimed is:

1. A method of treating papillary thyroid cancer in a subject in need thereof, the method comprising:
   (i) measuring decreased DNA methylation levels, relative to a control, at papillary thyroid carcinoma DNA methylation sites in an isolated DNA obtained from a thyroid nodule from the subject, wherein the papillary thyroid carcinoma DNA methylation sites, with respect to reference human genome assembly hg19, comprise:
      (a) chromosome 10, position 112259015,
      (b) chromosome 12, position 56115043, and
      (c) chromosome 15, position 85402496; and
   (ii) administering cabozantinib-S-malate, doxorubicin hydrochloride, lenvatinib mesylate, sorafenib tosylate, vandetanib, or a combination of two or more thereof to the subject having the decreased DNA methylation levels at the papillary thyroid carcinoma DNA methylation sites in step (i) to treat the papillary thyroid cancer.

2. The method of claim 1, further comprising measuring a decreased DNA methylation level, relative to a control, at a benign thyroid nodule DNA methylation site in an isolated DNA obtained from a thyroid nodule from the subject, wherein the benign thyroid nodule DNA methylation site, with respect to reference human genome assembly hg19, is chromosome 2, position 8793724.

3. The method of claim 1, further comprising measuring a decreased DNA methylation level, relative to a control, at a benign thyroid nodule DNA methylation site in an isolated DNA obtained from a thyroid nodule from the subject, wherein the benign thyroid nodule DNA methylation site, with respect to reference human genome assembly hg19, is chromosome 12, position 45610695.

4. The method of claim 1, wherein the papillary thyroid carcinoma DNA methylation sites are unmethylated.

5. The method of claim 1, wherein the control is a subject that does not have papillary thyroid cancer.

6. The method of claim 1, wherein the papillary thyroid carcinoma DNA methylation sites, with respect to human genome assembly hg19, consist of: (a) chromosome 10, position 112259015, (b) chromosome 12, position 56115043, and (c) chromosome 15, position 85402496.

7. The method of claim 1, wherein the isolated DNA is obtained from the thyroid nodule in the subject by a biopsy or a surgical resection.

8. The method of claim 1, wherein the subject: (a) is a woman; (b) is about 20 years old to about 55 years old; (c) has a mutated Ret proto-oncogene; (d) has a grandparent, parent, or sibling who has been diagnosed with thyroid cancer; (e) self-identifies as Caucasian or Asian; (f) has or has had breast cancer, or (g) any combination of two or more of (a)-(f).

9. A method of measuring DNA methylation levels at papillary thyroid carcinoma DNA methylation sites in a human subject with thyroid carcinoma, the method comprising measuring decreased DNA methylation levels, relative to a control, at papillary thyroid carcinoma DNA methylation sites in an isolated DNA obtained from a thyroid nodule from the human subject, wherein the papillary thyroid carcinoma DNA methylation sites, with respect to reference human genome assembly hg19, comprise: (a) chromosome 10, position 112259015, (b) chromosome 12, position 56115043, and (c) chromosome 15, position 85402496 and measuring methylation levels comprises amplifying DNA by contacting the DNA with a primer complementary to a sequence at or within 1000 nucleotides of the chromosomal positions to produce amplicons thereof to measure methylation levels.

10. The method of claim 9, wherein the papillary thyroid carcinoma DNA methylation sites are unmethylated.

11. The method of claim 9, wherein the control is a subject that does not have papillary thyroid cancer.

12. The method of claim 9, further comprising measuring a decreased DNA methylation level, relative to a control, at a benign thyroid nodule DNA methylation site in an isolated DNA obtained from a thyroid nodule from the subject, wherein the benign thyroid nodule DNA methylation site, with respect to reference human genome assembly hg19, is chromosome 2, position 8793724.

13. The method of claim 9, further comprising measuring a decreased DNA methylation level, relative to a control, at a benign thyroid nodule DNA methylation site in an isolated DNA obtained from a thyroid nodule from the subject, wherein the benign thyroid nodule DNA methylation site, with respect to reference human genome assembly hg19, is chromosome 12, position 45610695.

14. The method of claim 9, wherein the isolated DNA is obtained from the thyroid nodule in the subject by a biopsy or a surgical resection.

15. The method of claim 9, wherein the papillary thyroid carcinoma DNA methylation sites are unmethylated.

16. A method of measuring DNA methylation levels at papillary thyroid carcinoma methylation sites in an isolated DNA obtained from a thyroid nodule in a human subject, the method comprising: (i) contacting the isolated DNA with a bisulfite salt, thereby forming a reacted thyroid nodule DNA, and (ii) measuring decreased DNA methylation levels, relative to a control, at papillary thyroid carcinoma DNA methylation sites by detecting the presence of uracil in the reacted thyroid nodule DNA; wherein the papillary thyroid carcinoma DNA methylation sites, with respect to reference human genome assembly hg19, comprise: (a) chromosome 10, position 112259015, (b) chromosome 12, position 56115043, and (c) chromosome 15, position 85402496 and measuring methylation levels comprises amplifying DNA by contacting the DNA with a primer complementary to a sequence at or within 1000 nucleotides of the chromosomal positions to produce amplicons thereof to measure methylation levels.

17. The method of claim 16, wherein the bisulfite salt is sodium bisulfite or ammonium bisulfite.

18. The method of claim 16, wherein the bisulfite salt is sodium bisulfite, potassium bisulfite, ammonium bisulfite, magnesium bisulfite, sodium metabisulfite, potassium metabisulfite, ammonium metabisulfite and magnesium metabisulfite.

19. The method of claim 16, wherein the control is a subject that does not have papillary thyroid cancer.

20. The method of claim 16, wherein the isolated DNA is obtained from the thyroid nodule in the subject by a biopsy or by a surgical resection.

* * * * *